US008932605B2

(12) United States Patent  
Song et al.

(10) Patent No.: US 8,932,605 B2
(45) Date of Patent: Jan. 13, 2015

(54) DELETION MUTANTS OF FLAGELLIN AND METHODS OF USE

(75) Inventors: Langzhou Song, Freehold, NJ (US); Lynda G. Tussey, Princeton, NJ (US); Alan R. Shaw, Doylestown, PA (US); Robert S. Becker, Nazareth, PA (US); Yi Zhang, Edison, NJ (US); Scott W. Umlauf, Pennington, NJ (US); Ge Liu, East Brunswick, NJ (US)

(73) Assignee: VaxInnate Corporation, Cranbury, NJ (US)

( * ) Notice: Subject to any disclaimer, the term of this patent is extended or adjusted under 35 U.S.C. 154(b) by 96 days.

(21) Appl. No.: 12/905,584

(22) Filed: Oct. 15, 2010

(65) Prior Publication Data

US 2011/0135680 A1 Jun. 9, 2011

Related U.S. Application Data

(63) Continuation-in-part of application No. PCT/US2009/002428, filed on Apr. 17, 2009, and a continuation-in-part of application No. PCT/US2009/002427, filed on Apr. 17, 2009, and a continuation-in-part of application No. PCT/US2009/002429, filed on Apr. 17, 2009, and a continuation-in-part of application No. PCT/US2009/002430, filed on Apr. 17, 2009.

(60) Provisional application No. 61/124,617, filed on Apr. 18, 2008, provisional application No. 61/124,604, filed on Apr. 18, 2008, provisional application No. 61/124,670, filed on Apr. 18, 2008, provisional application No. 61/125,660, filed on Apr. 25, 2008, provisional application No. 61/126,993, filed on May 8, 2008, provisional application No. 61/126,978, filed on May 8, 2008, provisional application No. 61/132,594, filed on Jun. 20, 2008, provisional application No. 61/137,840, filed on Aug. 4, 2008, provisional application No. 61/199,793, filed on Nov. 19, 2008, provisional application No. 61/200,354, filed on Nov. 26, 2008.

(51) Int. Cl.
*A61K 39/295* (2006.01)
*A61K 39/145* (2006.01)
*A61K 39/00* (2006.01)

(52) U.S. Cl.
USPC .............. 424/201.1; 424/192.1; 424/210.1

(58) Field of Classification Search
None
See application file for complete search history.

(56) References Cited

U.S. PATENT DOCUMENTS

| | | | |
|---|---|---|---|
| 4,474,757 | A | 10/1984 | Arnon et al. |
| 4,625,015 | A | 11/1986 | Green et al. |
| 4,659,669 | A | 4/1987 | Kleid et al. |
| 4,752,473 | A | 6/1988 | Nayak et al. |
| 5,500,366 | A | 3/1996 | Russell-Jones et al. |
| 5,612,037 | A | 3/1997 | Huebner et al. |
| 5,700,680 | A | 12/1997 | Newton et al. |
| 5,762,939 | A | 6/1998 | Smith et al. |
| 5,858,368 | A | 1/1999 | Smith et al. |
| 5,871,747 | A | 2/1999 | Gengoux-Sedlik et al. |
| 5,877,289 | A | 3/1999 | Thorpe et al. |
| 5,928,644 | A | 7/1999 | Russell-Jones et al. |
| 5,962,298 | A | 10/1999 | Fiers et al. |
| 5,976,552 | A | 11/1999 | Volvovitz |
| 6,130,082 | A | 10/2000 | Majarian et al. |
| 6,194,546 | B1 | 2/2001 | Newton et al. |
| 6,245,532 | B1 | 6/2001 | Smith et al. |
| 6,337,070 | B1 | 1/2002 | Okuno et al. |
| 6,605,457 | B1 | 8/2003 | Fiers et al. |
| 6,740,325 | B1 | 5/2004 | Arnon et al. |
| 6,936,263 | B2 | 8/2005 | Revets et al. |
| 7,192,595 | B2 | 3/2007 | Arnon et al. |
| 7,361,352 | B2 | 4/2008 | Birkett et al. |
| 7,404,963 | B2 | 7/2008 | Sotomayor et al. |
| 7,514,086 | B2 | 4/2009 | Arnon et al. |
| 7,731,972 | B1 | 6/2010 | Neirynck et al. |
| 7,732,130 | B2 | 6/2010 | Neirynck et al. |
| 7,993,652 | B2 | 8/2011 | Neirynck et al. |
| 8,017,127 | B2 | 9/2011 | Birkett |
| 2002/0061312 | A1 | 5/2002 | Medzhitov |
| 2003/0044429 | A1 | 3/2003 | Aderem et al. |
| 2003/0059439 | A1 | 3/2003 | Revets et al. |
| 2003/0099668 | A1 | 5/2003 | Bachmann et al. |
| 2003/0129197 | A1 | 7/2003 | Fiers et al. |
| 2003/0175287 | A1 | 9/2003 | Medzhitov et al. |

(Continued)

FOREIGN PATENT DOCUMENTS

AU 49273 90 8/1990
AU 707083 7/1998

(Continued)

OTHER PUBLICATIONS

Zhang et al. Journal of Pharmaceutical Sciences, vol. 96, No. 12, Dec. 2007, p. 3283-3292.*
Akira, S., et al., "Recognition of Pathogen-associated Molecular Patterns by TLR Family," *Immuno. Letters*, 85:85-95 (2003).
Andersen-Nissen et al., "Evasion of Toll-like Receptor 5 by Flagellated Bateria," PNAS, Jun. 13, 2005, vol. 102, pp. 9247-9252.

(Continued)

*Primary Examiner* — Oluwatosin Ogunbiyi
(74) *Attorney, Agent, or Firm* — Hamilton, Brook, Smith & Reynolds, P.C.

(57) ABSTRACT

Compositions that include Toll-like Receptor 5 agonists and at least a portion of at least one viral antigen can be employed in methods that stimulate an immune response in a subject, in particular, a protective immune response in a subject. Compositions can be associated with particles and employed in the methods in relatively low doses to provide protective immunity to viral infection.

45 Claims, 80 Drawing Sheets

(56) References Cited

U.S. PATENT DOCUMENTS

| | | |
|---|---|---|
| 2003/0175863 A1 | 9/2003 | Birkett |
| 2003/0232055 A1 | 12/2003 | Medzhitov et al. |
| 2004/0116664 A1 | 6/2004 | De Filette et al. |
| 2004/0223976 A1 | 11/2004 | Bianchi et al. |
| 2005/0002954 A1 | 1/2005 | Arnon et al. |
| 2005/0009008 A1 | 1/2005 | Robinson et al. |
| 2005/0147627 A1 | 7/2005 | Aderem et al. |
| 2005/0186621 A1 | 8/2005 | Galarza et al. |
| 2006/0246092 A1 | 11/2006 | Neirynck et al. |
| 2007/0042001 A1 | 2/2007 | Weeks-Levy et al. |
| 2007/0042002 A1 | 2/2007 | Weeks-Levy et al. |
| 2007/0111331 A1* | 5/2007 | Hong et al. .............. 436/526 |
| 2007/0122421 A1 | 5/2007 | Medzhitov |
| 2007/0160623 A1 | 7/2007 | Medzhitov |
| 2007/0224205 A1* | 9/2007 | Powell et al. ............. 424/159.1 |
| 2007/0253982 A1 | 11/2007 | Song et al. |
| 2008/0008725 A1 | 1/2008 | Weeks-Levy et al. |
| 2008/0063657 A1 | 3/2008 | Powell et al. |
| 2008/0124361 A1 | 5/2008 | Mizel et al. |
| 2008/0193487 A1 | 8/2008 | Schild et al. |
| 2008/0220011 A1 | 9/2008 | Mizel et al. |
| 2008/0226667 A1 | 9/2008 | Medzhitov |
| 2009/0081725 A1 | 3/2009 | Powell et al. |
| 2009/0162400 A1 | 6/2009 | Powell et al. |
| 2009/0297552 A1 | 12/2009 | Aderem et al. |
| 2010/0015170 A1 | 1/2010 | Takeshita et al. |
| 2010/0303847 A1 | 12/2010 | Nakaar et al. |
| 2011/0008383 A1 | 1/2011 | Powell et al. |
| 2011/0117128 A1 | 5/2011 | Powell et al. |
| 2013/0095130 A1 | 4/2013 | Taylor et al. |
| 2013/0136763 A1 | 5/2013 | Song et al. |
| 2013/0224798 A1 | 8/2013 | Song et al. |
| 2013/0330367 A1 | 12/2013 | Song et al. |
| 2013/0331548 A1 | 12/2013 | Nakaar et al. |
| 2014/0037683 A1 | 2/2014 | Powell et al. |
| 2014/0065177 A1 | 3/2014 | Song et al. |

FOREIGN PATENT DOCUMENTS

| | | |
|---|---|---|
| EP | 0222835 B2 | 9/1994 |
| EP | 0419513 B1 | 4/1995 |
| EP | 0621339 B1 | 10/2001 |
| EP | 0833933 B1 | 9/2005 |
| WO | WO 88/01873 | 3/1988 |
| WO | WO 89/10967 | 11/1989 |
| WO | WO 93/03173 | 2/1993 |
| WO | WO 93/07897 | 4/1993 |
| WO | WO 93/20846 | 10/1993 |
| WO | WO 96/32963 | 10/1996 |
| WO | WO 98/23288 | 6/1998 |
| WO | WO 98/40100 | 9/1998 |
| WO | WO 98/48026 | 10/1998 |
| WO | WO 98/55495 | 12/1998 |
| WO | WO 99/16455 | 4/1999 |
| WO | WO 99/28478 | 6/1999 |
| WO | WO 99/66957 | 12/1999 |
| WO | WO 00/23570 | 4/2000 |
| WO | WO 00/32228 | 8/2000 |
| WO | WO 01/40280 A2 | 6/2001 |
| WO | WO 02/00885 A2 | 1/2002 |
| WO | WO 02/09748 | 2/2002 |
| WO | WO 02/085933 | 10/2002 |
| WO | WO 03/051305 | 6/2003 |
| WO | WO 03/102165 A2 | 12/2003 |
| WO | WO 2004/076621 A2 | 9/2004 |
| WO | WO 2004/080403 A2 | 9/2004 |
| WO | WO 2005/042564 A1 | 5/2005 |
| WO | WO 2005/055957 A2 | 6/2005 |
| WO | WO 2005/072088 | 8/2005 |
| WO | WO 2005/077408 A2 | 8/2005 |
| WO | WO 2006/040076 A2 | 4/2006 |
| WO | WO 2006/042156 A2 | 4/2006 |
| WO | WO 2006/069262 A2 | 6/2006 |
| WO | WO 2006/077448 * | 7/2006 |
| WO | WO 2006/078657 | 7/2006 |
| WO | WO 2006/078657 A2 | 7/2006 |
| WO | WO 2006/081007 | 8/2006 |
| WO | WO 2006/083706 | 8/2006 |
| WO | WO 2006/083792 | 8/2006 |
| WO | WO 2007/022425 A2 | 2/2007 |
| WO | WO 2007/066334 A1 | 6/2007 |
| WO | WO 2007/085969 A2 | 8/2007 |
| WO | WO 2007/103322 | 9/2007 |
| WO | WO 2007/125535 A1 | 11/2007 |
| WO | WO 2009/073133 | 6/2009 |
| WO | WO 2009/082440 | 7/2009 |
| WO | WO 2009/128949 A2 | 10/2009 |
| WO | WO 2009/128950 A2 | 10/2009 |
| WO | WO 2009/128951 | 10/2009 |
| WO | WO 2012/115715 | 8/2012 |

OTHER PUBLICATIONS

Applequist, S.E., et al. "Activation of Innate Immunity, Inflammation, and Potentiation of DNA Vaccination through Mammalian Expression of the TLR5 Agonist Flagellin" *J. Immunol.* 175:3882-3891 (2005).

Arnon, R. et al. "Peptide-based Synthetic Recombinant Vaccines with Anti-viral Efficacy" Biologicals, 29:237-242 (2001).

Barton, G. M., and R. Medzhitov, "Control of adaptive immune responses by Toll-like receptors," Curr Opin Immunol 14:380-383 (Jun. 2002).

Beatson, S., et al., "Variation in Bacterial Flagellins: From Sequence to Structure," Trends in Microbiology, 14:151-156 (2006).

Bendelac, A. and R. Medzhitov (2002). "Adjuvants of immunity: harnessing innate immunity to promote adaptive immunity." J Exp Med 195(5): F19-23.

Ben-Yedidia, T. and Arnon, R., "Towards an Epitope-Based Human Vaccine for Influenza," *Human Vaccines* 1(3):95-101 (2005).

Ben-Yedidia, T., et al. "Intranasal administration of peptide vaccine protects human/mouse radiation chimera from influenza infection" Internation Immunol.11(7):1043-1051 (1999).

Ben-Yedidia, T., et al., "Intranasal Administration of Synthetic Recombinant Peptide-Based Vaccine Protects Mice From Infection by *Schistosoma mansoni*," Infection and Immunity, 67(9):4360-4366 (1999).

Bianchi, E., et al., "Universal Influenza B Vaccine Based on the Maturational Cleavage Site of the Hemagglutinin Precursor," *J. of Virology*, 79(12):7380-7388 (2005).

Blander, J. M. and R. Medzhitov (2006). "Toll-dependent selection of microbial antigens for presentation by dendritic cells." Nature 440(7085): 808-12.

Bright, R.A., et al., "Impact of glycosylation and immunogenicity of DNA-based influenza H5 HA vaccine," *Virology*, 308:270-278 (2003).

Chan, V.W.F., et al., "The Molecular Mechanism of B Cell Activation by Toll-Like Receptor Protein RP-105," J. Exp. Med., 188(1):93-101 (1998).

Chen, H., et al., "Avian flu: H5N1 virus outbreak in migratory waterfowl," Nature 436:191-192 (Jul. 2005).

Cornelis, P., et al., "Development of New Cloning Vectors for the Production of Immunogenic Outer Membrane Fusion Proteins in *Escherichia coli*," Bio/Technology, 14:203-208 (1996).

Cox, et al., "Identification of Sequence Changes in the Cold-Adapted, Live Attenuated Influenza Vaccine Strain, A/Ann Arbor/6/60 (H2N2)," *Virology*, 167:554-567 (1988).

Cuadros, C., et al., "Flagellin Fusion Proteins as Adjuvants or Vaccines Induce Specific Immune Responses," Infection and Immunity, 72(5):2810-2816 (2004).

Daniels, R., et al., "N-Linked Glycans Direct the Cotranslational Folding Pathway of *Influenza* Hemagglutinin," *Molecular Cell*, 11:79-90 (2003).

das Gracas Luna, M., et al., "*Salmonella* Flagellin Fused with a Linear Epitope of Colonization Factor Antigen I (CFA/I) Can Prime Antibody Responses Against Homologous and Heterologous Fimbriae of Entertoxigenic *Escherichia coli*," Research in Microbiology, 151: 575-582 (2000).

(56) References Cited

OTHER PUBLICATIONS

Database UniProt [Online] Jul. 5, 2004, "SubName: Full=Phase 2 flagellin;" XP002539993, retrieved from EBI accession No. UNIPROT:Q6V357, Database accession No. Q6V357, abstract.
Dempsey, P.W., et al., C3d of Complement as a Molecular Adjuvant: Bridging Innate and Acquired Immunity, Science, 271:348-350 (1996).
de Vries,N., et al., "Production of Monoclonal Antibodies Specific for the i and 1,2 Flagellar Antigens of Salmonella typhimurium and Characterization of Their Respective Epitopes," Applied and Environmental Microbiology, 64(12): 5033-5038 (Dec. 1998).
Donnelly, M. A. et al. "Two Nonadjacent Regions in Enteroaggregative Escherichia coli Flagellin are Required for Activation of Toll-like Receptor 5" J. Biol. Chem. 277(43):40456-40461 (2002).
Eaves-Pyles, T., et al., "Flagellin, a Novel Mediator of Salmonella-Induced Epithelial Activation and Systematic Inflammation: IκBα Degradation, Induction of Nitric Oxide Synthase, Induction of Proinflammatory Mediators, and Cardiovascular Dysfunction," J. Immunol, 166:1248-1260 (2001).
Eaves-Pyles, T.D. et al., "Salmonella Flagellin-Dependent Proinflammatory Responses are Localized to the Conserved Amino and Carboxyl Regions of the Protein," The Journal of Immunology, 167: 7009-7016 (2001).
Fearon, D.T., and Locksley, R.M., "The Instructive Role of Innate Immunity in the Acquired Immune Response," Science, 272:50-54 (1996).
Fereidouni, S.R. et al., "Isolation and identification of avian influenza viruses from migratory birds in Iran," Vet Rec 157:526 (2005).
Fiers, W., et al., "A "Universal" Human Influenza A Vaccine," Virus Research 103:173-176 (2004).
Fingerut, E., et al., "B subunit of E. coli enterotoxin as adjuvant and carrier in oral and skin vaccination," Vet Immunol Immunopathol 112:253-263 (2006).
Gamblin, S.J. et al. "The structure and receptor binding properties of the 1918 influenza hemagglutinin" Science, 303:1838-1842 (2004).
Geisse, S., et al., "Eukaryotic Expression Systems: A Comparison," Protein Expression and Purification 8:271-282 (1996).
Gewirtz, A.T., et al., "Salmonella typhimurium Translocates Flagellin Across Intestinal Epithelia, Inducing a Proinflammatory Response," J. Clin. Invest., 107(1):99-109 (2001).
Hayashi, F., et al., The Innate Immune Response to Bacterial Flagellin is Mediated by Toll-Like Receptor 5, Nature, 410:1099-1103 (2001).
Hongo, S., et al., "Characterization of a Second Protein (CM2) Encoded by RNA Segment 6 of Influenza C Virus," J. of Virol., 71(4): 2786-2792 (1997).
Honko, A.N., et al., "Mucosal Administration of Flagellin Induces Innate Immunity in the Mouse Lung," Infection and Immunity, 72(11):6676-6679 (2004).
Horvath, A., et al., "A Hemagglutinin-based Multipeptide Construct Elicits Enhanced Protective Immune Response in Mice Against Influenza A Virus Infection," Immunol. Lett., 60:127-136 (1998).
Huleatt, J.W., et al., "Vaccination with Recombinant Fusion Proteins Incorporating Toll-Like Receptor Ligands Induces Rapid Cellular and Humoral Immunity," Vaccine 25:763-775 (2007).
Huleatt, J.W., et al., "Potent Immunogenicity and Efficacy of a Universal Influenza Vaccine Candidate Comprising a Recombinant Fusion Protein Linking Influenza M2c to the TLR5 Ligand Flagellin," Vaccine, Butterworth Scientific Guildford, GB, 26:2, 201-214 (Nov. 2007).
Ibrahim, G.F., et al., "Method for the isolation of highly purified Salmonella flagellins.," J. Clin. Microbial., 22:1040-1044, (1985).
Liu, J., et al., "Highly Pathogenic H5N1 Influenza Virus Infection in Migratory Birds," Science 309:1206 (Jul. 2005).
Notification Concerning Transmittal of International Preliminary Report on Patentability (Chapter I of the Patent Cooperation Treaty), for Int'l Application PCT/US2009/002428; Date of Mailing Oct. 19, 2010.
Notification of Transmittal of the International Search Report and the Written Opinion of the International Searching Authority, or the Declaration for Int'l Application No. PCT/US2009/002428; Date Mailed: Feb. 23, 2010.
Janeway, Jr., C.A. and Medzhitov, R., "Innate Immunity: Lipoproteins Take Their Toll on the Host," Current Biology, 9(23):R879-R882 (1999).
Janeway, Jr., C.A., "Approaching the Asymptote? Evolution and Revolution in Immunology," Cold Spring Harbor Symposia on Quantitative Biology, LIV: 1-13 (1989).
Jegerlehner, A., et al., "Influenza A Vaccine Based on the Extracellular Domain of M2: Weak Protection Mediated via Antibody-Dependent NK Cell Activity," J. Immunol 172:5598-5605 (May 2004).
Jegerlehner, A., et al., "A Molecular Assembly System that Renders Antigens of Choice Highly Repetitive for Induction of Protective B Cell Responses," Vaccine 20:3104-3112 (2002).
Jeon, S.H. et al., "Immunization with Influenza Virus Hemagglutinin Globular Region Containing the Receptor-Binding Pocket" Viral Immunol, 15(1):165-176 (2002).
Jeon, S.H. et al., "Intranasal Immunization with Synthetic Recombinant Vaccine Containing Multiple Epitopes of Influenza Virus," Vaccine, 20:2772-2780 (2002).
Kobayashi, K., et al., "RICK/Rip2/CARDIAK Mediates Signalling for Receptors of the Innate and Adaptive Immune Systems," Nature, 416:194-199 (2002).
Kopp, E.B. and Medzhitov, R., "The Toll-Receptor Family and Control of Innate Immunity," Current Opinion in Immunology, 11:13-18 (1999).
Kovacsovics-Bankowski, M., et al., "Efficient Major Histocompatibility Complex Class I Presentation of Exogeneous Antigen Upon Phagocytosis by Macrophages," PNAS, 90:4942-4946 (1993).
Krieg, A., "The Role of CpG Motifs in Innate Immunity," Current Opinion in Immunology, 12:35-43 (2000).
Lamb, R.A., et al., "Influenza Virus M2 Protein is an Integral Membrane Protein Expressed on the Infected-cell Surface," Cell, 40:627-633 (1985).
Levi, R. and Arnon, R., "Synthetic Recombinant Influenza Vaccine Induces Efficient Long-Term Immunity and Cross-Strain Protection," Vaccine, 14(1):85-92 (1996).
Liu, W., et al., "Monoclonal antibodies recognizing EVETPRIN epitope of influenza A virus M2 protein could protect mice from lethal influenza A virus challenge," Immunol Lett 93:131-136 (2004).
McDonald, W. F., J. W. Huleatt, H. G. Foellmer, D. Hewitt, J. Tang, P. Desai, A. Price, A. Jacobs, V. N. Takahashi, Y. Huang, V. Nakaar, L. Alexopoulou, E. Fikrig, and T. J. Powell. 2007. A west nile virus recombinant protein vaccine that coactivates innate and adaptive immunity. J Infect Dis 195:1607-1617(2007).
McEwen, J., et al., "Synthetic Recombinant Vaccine Expressing Influenza Heamagglutinin Epitope in Salmonella Flagellin Leads to Partial Protection in Mice," Vaccine, 10(6): 405-411 (1992).
McQuiston, J.R., et al., "Sequencing and Comparative Analysis of Flagellin Genes flicC, fljB, and flpA from Salmonella," J. of Clinical Micro., 42(5):1923-1932 (2004).
McSorley, S.J., et al., "Bacterial Flagellin is an Effective Adjuvant for CD4+ T Cells in Vivo," The Journal of Immunology, 169:3914-3919 (2002).
Means, T. K., F. Hayashi, et al. (2003). "The 5 stimulus bacterial flagellin induces maturation and chemokine production in human dendritic cells." J Immunol 170(10): 5165-5175(2003).
Medzhitov, R., "Toll-Like Receptors and Innate Immunity," Nature Immunology, 1:135-145 (2001).
Medzhitov, R., and Janeway, Jr., C., "An Ancient System of Host Defense," Current Opinion in Immunology, 10:12-15 (1998).
Medzhitov, R., and Janeway, Jr., C., "Innate Immune Recognition and Control of Adaptive Immune Responses," Seminars in Immunology, 10:351-353 (1998).
Medzhitov, R., and Janeway, Jr., C., "Innate Immune Recognition: Mechanism and Pathways," Immunological Reviews, 173:89-97 (2000).
Medzhitov, R., and Janeway, Jr., C., "Innate Immunity," The New England Journal of Medicine, 343:338-344 (2000).

(56) References Cited

OTHER PUBLICATIONS

Medzhitov, R., and Janeway, Jr., C., "Innate Immunity: Impact on the Adaptive Immune Response," *Current Opinion in Immunology*, 9(1):4-9 (1997).
Medzhitov, R., and Janeway, Jr., C., "Innate Immunity: The Virtues of a Nonclonal System of Recognition," *Cell*, 91:295-298 (1997).
Medzhitov, R., and Janeway, Jr., C., "Self-Defense: The Fruit Fly Style," *Proc. Natl. Acad. Sci. USA*, 95:429-430 (1998).
Medzhitov, R., and Janeway, Jr., C., "The Toll Receptor Family and Microbial Recognition," *Trends in Microbiology*, 8(10):452-456 (2000).
Medzhitov, R., et al., "A Human Homologue of the *Drosophila* Toll Protein Signals Activation of Adaptive Immunity," *Nature*, 388:394-397 (1997).
Medzhitov, R., et al., "How Does the Immune System Distinguish Self from Nonself?" *Seminars in Immunology*, 12:185-188 (2000).
Medzhitov, R., et al., "MyD88 is an Adaptor Protein in the hToll/IL-1 Receptor Family Signaling Pathways," *Molecular Cell*, 2:253-258 (1998).
Mizel, Steven B., et al. "Flagellin-F1-V Fusion Protein is an Effective Plague Vaccine in Mice and Two Species of Nonhuman Primates." *Clinical and Vaccine Immunology.* 16(1): 21-28 (2009).
Mowat, A. McI., et al., "Oral Vaccination with Immune Stimulating Complexes," Immunology Letters, 65:133-140 (1999).
Mozdzanowska, K., et al., "Induction of influenza type A virus-specific resistance by immunization of mice with a synthetic multiple antigenic peptide vaccine that contains ectodomains of matrix protein 2," Vaccine 21: 2616-2626 (Jun. 2003).
Murthy, K.G.K. et al. "Identification of Conserved Domains in *Salmonella muenchen* Flagellin That are Essential for its Ability to Activate TLR5 and to Induce an Inflammatory Response in Vitro" J. Biol. Chem., 279:5667-5675 (2004).
Murthy K.G.K. et al., "Identification of Protein Motifs and the Role of Particular Amino Acids in Biological Activity of Flagellin as an Inducer of Proinflammatory Responses in Human Cells," FASEB Journal, Fed. of American Soc. for Experimental Biology, Bethesda, MC, US, vol. 17, No. 4-5, Mar. 1, 2003, p. Abstract 601.2, XP009120942, ISSN: 0892-6638, abstract.
Nagy, Z., et al., "The Intersubunit Region of the Influenza Virus Haemagglutinin is Recognized by Antibodies During Infection," Scand. J. Immunol., 40:281-291 (1994).
Nayak, D.P. et al. "Biological and immunological properties of haemagglutinin and neuraminidase expressed from cloned cDNAs in prokaryotic and eukaryotic cells" *Vaccine*, 3:165-171 (1985).
Neirynck, Sabine, "An Expression Plasmid Leading to the Presentation of Influenza M2 Protein Epitopes on the *E. coli* Cell Surface," (1987-1988) (unpublished dissertation, State University of Ghent).
Neirynck, S., "A Universal Influenza A vaccine based on the Extracellular Domain of the M2 Protein," *Nature Medicine* 5:1157-1163 (1999).
Newton, S.M.C., et al., "Immune Response to Cholera Toxin Epitope Inserted in *Salmonella* Flagellin," *Science*, 244(4900):70-72 (1989).
Ngo, J.T., et al., "Computational Complexity, Protein Structure Prediction, and the Levinthal Paradox," in *The Protein Folding Problem and Tertiary Structure Prediction*, Kenneth M. Merz and Scott M. Le Grand, eds. ( NY: Elsevier Science), pp. 491-495 (1994).
O'Hagan, D.T., et al., "Recent Developments in Adjuvants for Vaccines Against Infectious Diseases," Biomol. Eng., 18:69-85 (2001).
Pasare, C., and R. Medzhitov. 2004. "Toll-dependent control mechanisms of CD4 T cell activation. Immunity" 21:733.
Pasare, C. and R. Medzhitov (2004). "Toll-like receptors and acquired immunity." Semin Immunol 16(1): 23-6(2004).
Petrenko, V.A., et al., "Cloning and Expression in *Escherichia coli* of the Hemagglutinin Gen of Influenza Virus Subtype H1," Molecular Biology, 23(No. 3, Part 2):704-712 (1989).
Petrenko, V.A., et al., "Construction of a Gene of Hybrid Influenza Virus Hemagglutinin," *Molecular Biology*, 24(No. 2, Part 1):331-339 (1990).

Powers, D.C., et al., "Influenza A Virus Vaccines Containing Purified Recombinant H3 Hemagglutinin are Well Tolerated and Induce Protective Immune Responses in Healthy Adults," *Journal of Infectious Diseases*, 171:1595-1599 (1995).
Pumpens, P., et al., "Hepatitis B Virus Core Particles as Epitope Carriers," Intervirology, 38:63-74 (1995).
Rock, F.L., et al., A Family of Human Receptors Structurally Related to *Drosophila* Toll, *PNAS* 95:588-593 (1998).
Sadoff, J. C., W. R. Ballou, et al. (1988). "Oral *Salmonella typhimurium* vaccine expressing circumsporozoite protein protects against malaria." Science 240(4850): 336-8.
Saelens, X. et al. "Protection of mice against a lethal influenza virus challenge after immunization with yeast-derived secreted influenza virus hemagglutinin" *J. Biochem.*, 260:166-175 (1999).
Salman et al., "*Salmonella*-like Bioadhesive Nanoparticles," Journal of Controlled Release, Elsevier, Amsterdam, NL, vol. 106, No. 1-2, Aug. 18, 2005, pp. 1-13, XP005023644, ISSN: 0168-3659, abstract.
Schneerson, R., et al., "Haemophilus influenzae type B polysaccharide-protein conjugates: model for a new generation of capsular polysaccharide vaccines," Prog Clin Biol Res 47:77-94 (1980).
Schnare, M., et al., "Toll-Like Receptors Control Activation of Adaptive Immune Responses," *Nature Immunology*, 2(10):947-950 (2001).
Schreuder M.P., et al., "Yeast Expressing Hepatitis B Virus Surface Antigen Determinants on its Surface: Implications for a Possible Oral Vaccine," Vaccine, 14(5):383-388 (1996).
Singh, B.P., et al., "Toll-like Receptors and Their Role in Innate Immunity," *Current Science*, 85(8):1156-1164 (2003).
Smith, K.D., et al., "Toll-like Receptor 5 Recognizes a Conserved Site on Flagellin Required for Protofilament Formation and Bacterial Motility," Nat. Immunology, 4(12):1247-1253 (2003).
Smith, R.E., et al., "Immune-Stimulating Complexes Induce an IL-12-Dependent Cascade of Innate Immune Responses," The Journal of Immunology, 162:5536-5546 (1999).
Song, L., V. Nakaar, et al. (2008). "Efficacious recombinant influenza vaccines produced by high yield bacterial expression: a solution to global pandemic and seasonal needs." PLoS ONE 3(5): e2257.
Stocker, B.A.D., et al., "Immune Responses to Epitopes Inserted in *Salmonella* Flagellin," *Intern. Rev. Immunol*, 11:167-178 (1994).
Sugrue, R.J., et al., "Palmitoylation of the Influenza A Virus M2 Protein," Virol., 179:51-56 (1990).
Sztein, M. B., S. S. Wasserman, et al. (1994). "Cytokine production patterns and lymphoproliferative responses in volunteers orally immunized with attenuated vaccine strains of *Salmonella typhi*." J Infect Dis 170(6): 1508-17.
Taubenberger, J.K., et al., Characterization of the 1918 influenza virus polymerase genes, Nature 437:889-893 (Oct. 2005).
Tauszig, S., et al., "Toll-Related Receptors and the Control of Antimicrobial Peptide Expression in *Drosophila*," *PNAS*, 97(19):10520-10525 (2000).
Torok AM, et al., "*Helicobacter pylori* Induces Interleukin-8 Secretion by Toll-Like Receptor 2-and Toll-Like Receptor 5—Dependent and -Independent Pathways," *Infect. Immu.*, 73(3):1523-1531, (2005).
Treanor, J.J., et al., "Dose-related safety and immunogenicity of a trivalent baculovirus-expressed influenza-virus hemagglutinin vaccine in elderly adults" *J. Infectious Disease*, 193:1223-1228 (2006).
Treanor, J.J., et al., "Passively Transferred Monoclonal Antibody to the M2 Protein Inhibits Influenza A Virus Replication in Mice," *J. of Virol.*, 64(3): 1375-1377 (1990).
Treanor, J.J., et al., "Safety and Immunogenicity of a Recombinant Hemagglutinin Vaccine for H5 Influenza in Humans," *Vaccine* 19:1732-1737 (2001).
Tung, C.-S., et al. "Homology model of the structure of influenza B virus HA1" *J. General Virol.*, 85:3249-3259 (2004).
Ueda, M., and Tanaka, A., "Genetic Immobilization of Proteins on the Yeast Cell Surface," *Biotechnology Advances*, 18(2):121-140 (2000).
Ulrich, R., "Core Particles of Hepatitis B Virus as Carrier for Foreign Epitopes," *Advances in Virus Research*, 50:141-182 (1998).
van Duin, D., R. Medzhitov, et al. (2006). "Triggering TLR signaling in vaccination." Trends Immunol 27(1): 49-55.

(56) References Cited

OTHER PUBLICATIONS

Vanlandschoot, P., et al., "Molecular and Immunological Characterization of Soluble Aggregated A/Victoria/3/75 (H3N2) Influenza Haemagglutinin Expressed in Insect Cells," *Arch. Virol.*, 141:1715-1726 (1996).

Weimer, Eric T., et al. "A Fusion Protein Vaccine Containing OprF Epitope 8, OprI, and Type A and B Flagellins Promotes Enhanced Clearance of Nonmucoid *Pseudomonas aeruginosa*." Infection and Immunity. 77(6): 2356-2366 (2009).

Westerlund-Wikström, B., et al., "Functional Expression of Adhesive Peptides as Fusions to *Escherichia coli* Flagellin," *Protein Engineering*, 10(11):1319-1326 (1997).

Westerlund-Wilkstrom, B., et al., "Peptide Display on Bacterial Flagella: Principles and Applications," *Int. J. Med. Microbiol.*, 290(3):223-230 (2000).

Wu, J.Y., et al., "Expression of Immunogenic Epitopes of Hepatitis B Surface Antigen with Hybrid Flagellin Proteins by a Vaccine Strain of *Salmonella*," *Proc. Nat. Acad. Sci. USA*, 86:4726-4730 (1989).

Wyant, T.L., et al., "Potent Immunoregulatory Effects of *Salmonella typhi* Flagella on Antigenic Stimulation of Human Peripheral Blood Mononuclear Cells," *Infection and Immunity*, 67(3):1338-1346 (1999).

Wyant, T.L., et al., "*Salmonella typhi* Flagella are Potent Inducers of Proinflammatory Cytokine Secretion by Human Monocytes," Infection and Immunity, 67(7):3619-3624 (1999).

Yinghua, L., "Progress in the Study of the Flagellins from *Salmonella*," *Foreign Medical Science (Volume Microbiology)* 5:24-26 (2002).

Yoshimura, A., et al., "Cutting Edge: Recognition of Gram-Positive Bacterial Cell Wall Components by the Innate Immune System Occurs Via Toll-Like Receptor 2," J. Immunol., 163:1-5 (1999).

Yoshioka et al., "Flagellar Filament Structure and Cell Motility of *Salmonella typhimurium* Mutants Lacking Part of the Outer Domain of Flagellin," *Journal of Bacteriology*, 1995, vol. 177, pp. 1090-1093.

Zebedee, S.L. and Lamb, R.A., "Influenza A Virus M2 Protein: Monoclonal Antibody Restriction of Virus Growth and Detection of M2 in Virions," *J. Virol.*, 62:2762-2772 (1988).

Zebedee, S.L., et al., "Characterization of the Influenza Virus M2 Intergral Membrane Protein and Expression at the Infected-cell Surface from Cloned cDNA," *J. Virol.*, 56:502-511 (1985).

Zeitlin, G.A., et al., "Avian influenza," Curr Infect Dis Rep 7:193-199 (2005).

Zhang, W.-Y., et al., "Alterations of the Carboxyl-terminal Amino Acid Residues of *Escherichia coli* Lipoprotein Affect the Formation of Murein-bound Lipoprotein," *The J. of Biol. Chem.*, 267(27):19560-19564 (1992).

Andersen-Nissen, E., et al., "A Conserved Surface on Toll-Like Receptor 5 Recognizes Bacterial Flagellin," *J. Exp. Med.*, 204(2):393-403 (Feb. 2007).

Conne, P., et al., "Immunogenicity of Trivalent Subunit versus Virosome-formulated Influenza Vaccines in Geriatric Patients," *Vaccine*. 15(15):1675-1679 (1997).

\* cited by examiner

Nasal virus load (means ± SD) in
A/Vietnam/1203/04 challenged ferrets

- Placebo
- R3.2xHA1-2 VN 15 μg
- R3.2xHA1-2 VN 45 μg
- R3.HA1-2 VN 15 μg
- R3.HA1-2 VN 45 μg Days post-infection

Figure 7

Body Temperature

- ● STF2.HA1-2 VN
- ▨ STF2.R3.2xHA1-2 VN
- ▲ F147

Figure 10G

CRP

- ● STF2.HA1-2 VN
- ▨ STF2.R3.2xHA1-2 VN
- ▲ F147

Figure 10H

**Effect of STF2.HA1 (SI) on Body Temperature:
6 Hours post vaccination**

DEN1

DEN2

DEN3

DEN4 seroconversion:  PBS       STF2Δ.DEN2EIII
                 0/10             9/10 mean $PRNT_{50}$ = 1:102
range = 1:20 – 1:160

Figure 51

IFN-γ ELISPOT

IL-5 ELISPOT

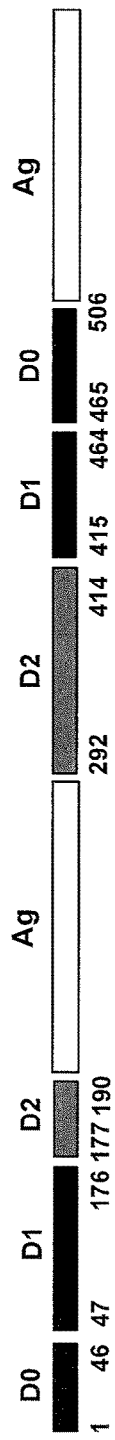
Figure 60

RSV-F disulfide bond assignments

QNITEEFYQSTCSAVSKGYLSALRTGWYTSVITIELSNIKENKCNGTDAKVKLIKQELDK

YKNAVTELQLLMQSTPATNNRARRELPRFMNYTLNNAKKTNVTLSKKRKRRFLGFLLGVG

SAIASGVAVSKVLHLEGEVNKIKSALLSTNKAVVSLSNGVSVLTSKVLDLKNYIDKQLLP

IVNKQSCSISNIETVIEFQQKNNRLLEITREFSVNAGVTTPVSTYMLTNSELLSLINDMP

ITNDQKLMSNNVQIVRQQSYSIMSIIKEEVLAYVVQLPLYGVIDTPCWKLHTSPLCTTN

TKEGSNICLTRTDRGWFCDNAGSVSFFPQAETCKVQSNRVFCDTMNSLTLPSEVNLCNVD

IFNPKYDCKIMTSKTDVSSSVITSLGAIVSCYGKTKCTASNKNRGIIKTFSNGCDYVSNK

GVDTVSVGNTLYYVNKQEGKSLYVKGEPIINFYDPLVFPSDEFDASISQVNEKINQSLAF

IRKSDELLHNVNAGKSTTN

Figure 65

Respiratory Syncytial Virus Vaccine
G Protein constructs

Figure 66

DELETION MUTANTS OF FLAGELLIN AND METHODS OF USE

RELATED APPLICATIONS

This application is a continuation-in-part of International Application No. PCT/US2009/002427, which designated the United States and was filed on Apr. 17, 2009, published in English; a continuation-in-part of International Application No. PCT/US2009/002428, which designated the United States and was filed on Apr. 17, 2009, published in English; a continuation-in-part of International Application No. PCT/US2009/002429, which designated the United States and was filed on Apr. 17, 2009, published in English; and a continuation-in-part of International Application No. PCT/US2009/002430, which designated the United States and was filed on Apr. 17, 2009, published in English, all of which claim the benefit of U.S. Provisional Application Nos. 61/124,617, filed on Apr. 18, 2008; 61/124,604, filed on Apr. 18, 2008; 61/124,670, filed on Apr. 18, 2008; 61/125,660, filed on Apr. 25, 2008; 61/126,993, filed on May 8, 2008; 61/126,978, filed on May 8, 2008; 61/132,594, filed on Jun. 20, 2008; 61/137,840, filed on Aug. 4, 2008; 61/199,793, filed on Nov. 19, 2008 and 61/200,354, filed on Nov. 26, 2008. The entire teachings of the above applications are incorporated herein by reference.

BACKGROUND OF THE INVENTION

Viral infection can lead to disease and, in some cases, death. Strategies to prevent and manage disease associated with viral infection, such as influenza viral infection, include the use of drugs and compositions of heat inactivate viruses or influenza antigens in combination with adjuvants. The only adjuvant approved for use in influenza vaccines in humans is alum, which is an aluminum based composition. Generally, influenza vaccine compositions can include antigens at concentrations that, in combination with alum, in humans, may have varying side effects, such as pain, inflammation and less than adequate efficacy. In addition, current methods of manufacturing influenza vaccines are generally inadequate to meet growing seasonal demand and changing influenza viruses to prevent disease consequent to influenza infection. Thus, there is a need to develop new, improved and effective compositions for use in methods of preventing and managing disease associated with or consequent to viral infection, such as, Dengue viral, respiratory syncytial virus (RSV) and human papillomavirus infection.

SUMMARY OF THE INVENTION

The present invention relates to compositions, such as compositions that stimulate a protective immune response, and methods of making proteins that stimulate a protective immune response in a subject.

In an embodiment, the invention is an amino acid sequence having at least about 50.0% identity to a contiguous amino acid sequence as set forth in SEQ ID NO: 29 (an R3 construct), including any insertions or deletions from SEQ ID NO: 29, wherein the isolated amino acid sequence activates a Toll-like Receptor 5.

In another embodiment, the invention is an amino acid sequence having at least about 50.0% identity to a contiguous amino acid sequence as set forth in SEQ ID NO: 30 (an R3D0 construct), including any insertions or deletions from SEQ ID NO: 30, wherein the isolated amino acid sequence activates a Toll-like Receptor 5.

In a further embodiment, the invention is an amino acid sequence having at least about 60.0% identity to a contiguous amino acid sequence as set forth in SEQ ID NO: 31 (an D3N construct), including any insertions or deletions from SEQ ID NO: 31, wherein the isolated amino acid sequence activates a Toll-like Receptor 5.

An additional embodiment of the invention is an amino acid sequence having at least about 60.0% identity to a contiguous amino acid sequence as set forth in SEQ ID NO: 32 (an D3NCs construct), including any insertions or deletions from SEQ ID NO: 32, wherein the isolated amino acid sequence activates a Toll-like Receptor 5.

In still another embodiment, the invention is an amino acid sequence as set forth in at least one member selected from the group consisting of SEQ ID NO: 29 (an R3 construct), SEQ ID NO: 30 (an R3D0 construct), SEQ ID NO: 31 (an D3N construct), SEQ ID NO: 32 (an D3NCs construct) and SEQ ID NO: 33 (an D1 construct).

Another embodiment of the invention is a fusion protein comprising, in sequence, at least one amino acid sequence as set forth in SEQ ID NO: 28 (an RO construct) and at least a portion of at least one antigen, wherein at least one amino acid residue of SEQ ID NO: 28 selected from the group consisting of 39, 46, 50, 378 and 382 is substituted with an alanine residue and wherein the fusion protein activates a Toll-like Receptor 5.

An additional embodiment, the invention is a fusion protein comprising at least one amino acid sequence as set forth in SEQ ID NO: 29 (an R3 construct) and at least a portion of at least one antigen, wherein the antigen is between amino acid residues 190 and 191 of SEQ ID NO: 29, and wherein the fusion protein activates a Toll-like Receptor 5.

Another embodiment of the invention is a fusion protein comprising, in sequence, at least one amino acid sequence as set forth in SEQ ID NO: 29 (an D3 construct) and at least a portion of at least one antigen, wherein the fusion protein activates a Toll-like Receptor 5.

In still another embodiment, the invention is a fusion protein comprising at least one amino acid sequence as set forth in SEQ ID NO: 30 (an R3D0 construct) and at least a portion of at least one antigen, wherein the antigen is between amino acid residues 145 and 146 of SEQ ID NO: 30 and the fusion protein activates a Toll-like Receptor 5.

A further embodiment of the invention is a fusion protein comprising at least one amino acid sequence as set forth in SEQ ID NO: 30 (an RO3 construct) and at least a portion of at least two antigens, wherein at least one antigen is between amino acid residues 145 and 146 of SEQ ID NO: 30 and at least one other antigen is fused to amino acid residue 318 of SEQ ID NO: 30, wherein the fusion protein activates a Toll-like Receptor 5.

An additional embodiment of the invention is a fusion protein comprising at least one amino acid sequence as set forth in SEQ ID NO: 29 (an R3-2xAg construct) and at least a portion of at least two antigens, wherein at least one antigen is between amino acid residues 190 and 191 of SEQ ID NO: 29 and at least one other antigen is fused to amino acid residue 405 of SEQ ID NO: 29, and wherein the fusion protein activates a Toll-like Receptor 5.

In yet another embodiment, the invention is a fusion protein comprising, in sequence, at least one amino acid sequence as set forth in SEQ ID NO: 31 (an D3N construct) and at least a portion of at least one antigen, wherein the fusion protein activates a Toll-like Receptor 5.

Another embodiment of the invention is a fusion protein comprising, in sequence, at least one amino acid sequence as set forth in SEQ ID NO: 32 (an D3NCs construct) and at least a portion of at least one antigen, wherein the fusion protein activates a Toll-like Receptor 5.

In still another embodiment, the invention is a fusion protein comprising, in sequence, at least one amino acid sequence as set forth in SEQ ID NO: 33 (an D1 construct) and at least a portion of at least one antigen, wherein the fusion protein activates a Toll-like Receptor 5.

An additional embodiment of the invention is a method of stimulating an immune response in a human, comprising the step of administering to the human a composition that includes at least one fusion protein selected from the group consisting of SEQ ID NOs: 451-453, 455, 457, 460, 463-465, 468, 470-474, 500-506, 511-518, 660, 664, 703, 705, 707, 709, 711, 713, 715, 717, 719, 721, 723, 725, 729, 731, 733, 735, 737, 739, 741, 743, 745, 747, 749, 751, 753, 755, 757, 759, 761, 763 and 801-812, wherein the fusion protein is administered to the human in at least one dose selected from the group consisting of about a 10.0 μg dose, about a 5.0 μg dose, about a 3.0 μg dose, about a 2.5 μg dose, about a 1.0 μg dose, about a 0.5 μg dose, about a 0.3 μg dose, about a 0.25 μg dose, about a 0.1 μg dose, about a 0.05 μg dose, about a 0.025 μg dose and about a 0.01 μg dose.

In a further embodiment, the invention is an isolated nucleic acid sequence encoding an amino acid sequence of a flagellin construct (an R0 construct, an R3 construct, an R3D0 construct, an R3-2xAg construct, an D3N construct, an D3NCs construct and a D1 construct) that activates Toll-like Receptor 5 agonists.

In yet another embodiment, the invention is an isolated nucleic acid sequence encoding a fusion protein that includes an influenza antigen and a flagellin construct that activates a Toll-like Receptor 5.

In another embodiment, the invention is a composition that includes a portion of a naturally occurring flagellin protein, wherein the portion includes, in sequence, an amino-domain 0, an amino-domain 1, an amino-domain 2, a carboxy-domain 2, a carboxy-domain 1 and a carboxy-domain 0 (an R3, an D3, an R3-2xAg constructs).

An additional embodiment of the invention is a composition that includes a portion of a naturally occurring flagellin protein, wherein the portion includes, in sequence, an amino-domain 1, an amino-domain 2, a carboxy-domain 2 and a carboxy-domain 1 (an R3D0 construct; an R03 construct).

In still another embodiment, the invention is a composition that includes a portion of a naturally occurring flagellin protein, wherein the portion includes, in sequence, an amino-domain 1, an amino-domain 2, a carboxy-domain 2, a carboxy-domain 1 and a carboxy-domain 0 (an D3N construct).

Another embodiment of the invention is a composition that includes a portion of a naturally occurring flagellin protein, wherein the portion includes, in sequence, an amino-domain 1, an amino-domain 2, a carboxy-domain 2, a carboxy-domain 1 and at least a portion of a carboxy-domain 0 (an D3NCs construct).

A further embodiment of the invention is a composition that includes a portion of a naturally occurring flagellin protein, wherein the portion includes, in sequence, an amino-domain 1, an amino-domain 2, a carboxy-domain 2 and a carboxy-domain 1 and wherein the portion of the naturally occurring flagellin lacks a portion of a carboxy-domain 0 (an D3NCs construct).

In yet another embodiment, the invention is a composition that includes a portion of a naturally occurring flagellin protein, wherein the portion includes, in sequence, an amino-domain 1 and a carboxy-domain 1 (an D1 construct).

An additional embodiment of the invention is a method of making a Toll-like Receptor 5 agonist, comprising the steps of separating a portion of a protein from a naturally occurring flagellin to thereby form a protein portion, wherein the protein portion includes, in sequence, an amino-domain 0, an amino-domain 1, an amino-domain 2, a carboxy-domain 2, a carboxy-domain 1 and a carboxy-domain 0 (an R3 construct, an D3 construct, an R3-2xAg construct); transforming a nucleic acid sequence encoding the protein portion into a host cell; and culturing the host cell to thereby make the Toll-like Receptor 5 agonist.

In still another embodiment, the invention is a method of making a Toll-like Receptor 5 agonist, comprising the steps of separating a portion of a protein from a naturally occurring flagellin to thereby form a protein portion, wherein the protein portion includes, in sequence, an amino-domain 1, an amino-domain 2, a carboxy-domain 2 and a carboxy-domain 1 (an R3D0 construct, an R03 construct); transforming a nucleic acid sequence encoding the protein portion into a host cell; and culturing the host cell to thereby make the Toll-like Receptor 5 agonist.

In yet another embodiment, the invention is a method of making a Toll-like Receptor 5 agonist, comprising the steps of separating a portion of a protein from a naturally occurring flagellin to thereby form a protein portion, wherein the protein portion includes, in sequence, an amino-domain 1, an amino-domain 2, a carboxy-domain 2, a carboxy-domain 1 and a carboxy-domain 0 (an D3N construct); transforming a nucleic acid sequence encoding the protein portion into a host cell; and culturing the host cell to thereby make the Toll-like Receptor 5 agonist.

Another embodiment of the invention is a method of making a Toll-like Receptor 5 agonist, comprising the steps of separating a portion of a protein from a naturally occurring flagellin to thereby form a protein portion, wherein the protein portion includes, in sequence, an amino-domain 1, an amino-domain 2, a carboxy-domain 2, a carboxy-domain 1, and wherein the protein portion lacks a portion of a carboxy-domain 0 (an D3NCs construct); transforming a nucleic acid sequence encoding the protein portion into a host cell; and culturing the host cell to thereby make the Toll-like Receptor 5 agonist.

In a further embodiment, the invention is a method of making a Toll-like Receptor 5 agonist, comprising the steps of separating a portion of a protein from a naturally occurring flagellin to thereby form a protein portion, wherein the protein portion includes, in sequence, an amino-domain 1 and a carboxy-domain 1 (an D1 construct); transforming a nucleic acid sequence encoding the protein portion into a host cell; and culturing the host cell to thereby make the Toll-like Receptor 5 agonist.

Another embodiment of the invention is a composition comprising at least one nanoparticle that includes at least a portion of at least one Toll-like Receptor agonist and at least a portion of at least one antigen, wherein the Toll-like Receptor agonist and the antigen are associated with the nanoparticle and a molar ratio of the Toll-like Receptor agonist to the antigen is no greater than about 1.

In still another embodiment, the invention is a composition comprising at least one nanoparticle that includes at least one Toll-like Receptor 7 agonist, at least one Toll-like Receptor 5 agonist and at least one antigen, wherein the Toll-like Receptor 7 agonist and the antigen are contained within the nanoparticle and the Toll-like Receptor 5 agonist is associated with an outer surface of the nanoparticle.

In another embodiment, the invention is a composition comprising at least one particle that includes at least a portion of at least one Toll-like Receptor 5 agonist, at least a portion of at least one antigen, and at least a portion of at least one additional Toll-like Receptor agonist selected from the group consisting of a Toll-like Receptor 7 agonist, a Toll-like Receptor 8 agonist and a Toll-like Receptor 9 agonist, wherein the additional Toll-like Receptor agonist and, optionally, the antigen are contained within the particle and the Toll-like Receptor 5 agonist is associated with an outer surface of the particle.

An additional embodiment of the invention is a method of making a nanoparticle composition, comprising the steps of combining at least a portion of at least one Toll-like Receptor agonist with at least a portion of at least one nanoparticle to form an association between the Toll-like Receptor agonist and the nanoparticle; and combining at least a portion of at least one antigen with the Toll-like Receptor agonist associated with the nanoparticle, wherein a molar ratio of the Toll-like Receptor agonist to the antigen is no greater than about 1, thereby forming the nanoparticle composition.

In yet another embodiment, the invention is a method of making a nanoparticle composition, comprising the steps of associating at least a portion of at least one Toll-like Receptor 5 agonist with a nanoparticle; contacting at least a portion of at least one Toll-like Receptor agonist selected from the group consisting of a Toll-like Receptor 7 agonist, a Toll-like Receptor 8 agonist and a Toll-like Receptor 9 agonist within the nanoparticle; and combining the nanoparticle containing the Toll-like Receptor agonist with at least a portion of at least one antigen, thereby forming the nanoparticle composition.

A further embodiment of the invention is a method of stimulating an immune response in a subject, comprising the step of administering to the subject a composition that includes at least one nanoparticle comprising at least a portion of at least one Toll-like Receptor agonist and at least a portion of at least one antigen, wherein the Toll-like Receptor agonist and the antigen are associated with the nanoparticle and the molar ratio of the Toll-like Receptor agonist to the antigen is no greater than about 1.

An additional embodiment of the invention is a method of stimulating an immune response in a subject, comprising the step of administering to the subject a composition that includes at least one nanoparticle comprising at least a portion of at least one Toll-like Receptor 7 agonist, at least a portion of at least one Toll-like Receptor 5 agonist and at least a portion of at least one antigen, wherein the Toll-like Receptor 7 agonist and the antigen are contained within the nanoparticle and the Toll-like Receptor 5 agonist is associated with an outer surface of the nanoparticle.

Another embodiment of the invention is a method of stimulating an immune response in a subject, comprising the step of administering to the subject a composition that includes at least one nanoparticle comprising at least a portion of at least one Toll-like Receptor 5 agonist, at least a portion of at least one antigen and at least a portion of at least one additional Toll-like Receptor agonist selected from the group consisting of a Toll-like Receptor 7 agonist, a Toll-like Receptor 8 agonist and a Toll-like Receptor 9 agonist, wherein the additional Toll-like Receptor agonist and, optionally, the antigen are contained within the nanoparticle and the Toll-like Receptor 5 agonist is associated with a surface of the nanoparticle.

In an embodiment, the invention is a composition comprising at least a portion of at least one Dengue viral antigen selected from the group consisting of SEQ ID NOs: 339, 343, 345, 347, 351-355, 371, 381-384, 387-390, 636, 638, 640, 642, 644, 646, 648, 650, 652, 654, 656 and 658 and at least one Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

In another embodiment, the invention is a composition comprising at least a portion of at least one Toll-like Receptor agonist and at least a portion of at least one Dengue viral antigen selected from the group consisting of SEQ ID NOs: 339, 343, 345, 347, 351-355, 371, 381-384, 387-390, 636, 638, 640, 642, 644, 646, 648, 650, 652, 654, 656 and 658, wherein the Toll-like Receptor agonist and the Dengue viral antigen are associated with a particle.

In a further embodiment, the invention is a composition that includes at least one Dengue viral antigen selected from the group consisting of SEQ ID NOs: 339, 343, 345, 347, 351-355, 371, 381-384, 387-390, 636, 638, 640, 642, 644, 646, 648, 650, 652, 654, 656 and 658 and at least one Toll-like Receptor 5 agonist.

In still another embodiment, the invention is a method of stimulating an immune response in a subject, comprising the step of administering to the subject a composition that includes at least a portion of at least one Dengue viral antigen selected from the group consisting of SEQ ID NOs: 339, 343, 345, 347, 351-355, 371, 381-384, 387-390, 636, 638, 640, 642, 644, 646, 648, 650, 652, 654, 656 and 658 and at least one Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

In still another embodiment, the invention is a method of stimulating an immune response in a subject, comprising the step of administering to the subject a composition that includes a composition that includes at least one Dengue viral antigen selected from the group consisting of SEQ ID NOs: 339, 343, 345, 347, 351-355, 371, 381-384, 387-390, 636, 638, 640, 642, 644, 646, 648, 650, 652, 654, 656 and 658 and at least one Toll-like Receptor 5 agonist.

In an embodiment, the invention is a composition comprising at least a portion of at least one Toll-like Receptor 5 agonist and at least a portion of at least one respiratory syncytial virus protein, wherein the Toll-like Receptor 5 agonist and the respiratory syncytial virus protein are associated with a particle in a molar ratio that is no greater than about 1.

In another embodiment, the invention is a composition comprising at least a portion of at least one respiratory syncytial virus protein and a Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1) and wherein the composition activates a Toll-like Receptor 5.

An additional embodiment of the invention is a composition comprising at least a portion of at least one respiratory syncytial virus nonstructural protein and a Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1) and wherein the composition activates a Toll-like Receptor 5.

In a further embodiment, the invention is a composition comprising at least a portion of at least one respiratory syncytial viral protein and at least one Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

In yet another embodiment, the invention is a method of stimulating an immune response in a subject, comprising the step of administering to the subject a composition that includes at least a portion of at least one Toll-like Receptor 5 agonist and at least a portion of at least one respiratory syncytial virus protein, wherein the Toll-like Receptor 5 agonist and the respiratory syncytial virus protein are associated with a particle in a molar ratio that is no greater than about 1.

In an additional embodiment, the invention is a method of stimulating an immune response in a subject, comprising the step of administering to the subject a composition that includes at least a portion of at least one respiratory syncytial virus fusion protein that includes at least one trimerization domain and at least a portion of a flagellin, wherein the composition activates a Toll-like Receptor 5.

In still another embodiment, the invention is a method of stimulating an immune response in a subject, comprising the step of administering to the subject a composition that includes at least a portion of at least one respiratory syncytial virus protein and a Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1) and wherein the composition activates a Toll-like Receptor 5.

Another embodiment of the invention is a method of stimulating an immune response in a subject, comprising the step of administering to the subject a composition that includes at least a portion of at least one respiratory syncytial virus nonstructural protein and a Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1) and wherein the composition activates a Toll-like Receptor 5.

In still another embodiment, the invention is a method of stimulating an immune response in a subject, comprising the step of administering to the subject a composition that includes at least a portion of at least one respiratory syncytial viral protein and at least one Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

In an embodiment, the invention is a composition comprising at least a portion of at least one papillomavirus tumor suppressor binding protein and at least one Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

In another embodiment, the invention is a composition comprising at least one Toll-like Receptor agonist and at least a portion of at least one papillomavirus tumor suppressor binding protein, wherein the Toll-like Receptor agonist and the papillomavirus tumor suppressor binding protein are associated with a particle.

In an additional embodiment, the invention is a composition that comprises at least a portion of at least one papillomavirus transforming protein, and at least one Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

Another embodiment of the invention is a composition that comprises at least a portion of at least one papillomavirus capsid protein, and at least one Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

A further embodiment of the invention is a composition that includes at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1) and at least a portion of at least one papillomavirus protein, wherein the papillomavirus protein includes at least one member selected from the group consisting of a papillomavirus E1 protein, a papillomavirus E2 protein, papillomavirus E6 protein, a papillomavirus E7 protein, a papillomavirus L1 protein and a papillomavirus L2 protein and wherein the composition activates a Toll-like Receptor 5.

In still another embodiment, the invention is a composition comprising at least one Toll-like Receptor agonist and at least a portion of at least one papillomavirus transforming protein, wherein the Toll-like Receptor agonist and the papillomavirus transforming protein are associated with a particle.

In yet another embodiment, the invention is a composition that includes at least one Toll-like Receptor 5 agonist and at least a portion of at least one papillomavirus protein, wherein the papillomavirus protein includes at least one member selected from the group consisting of a papillomavirus E1 protein, a papillomavirus E2 protein, a papillomavirus E6 protein, a papillomavirus E7 protein, a papillomavirus L1 protein and a papillomavirus L2 protein and wherein the Toll-like Receptor 5 agonist and the papillomavirus protein are associated with a particle.

In yet another embodiment, the invention is a composition comprising at least one Toll-like Receptor agonist and at least a portion of at least one papillomavirus capsid protein, wherein the Toll-like Receptor agonist and the papillomavirus capsid protein are associated with a particle.

In a further embodiment, the invention is a method of stimulating an immune response in a subject, comprising the step of administering to the subject a composition that includes at least a portion of at least one papillomavirus tumor suppressor binding protein and a Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

Another embodiment of the invention is a method of stimulating an immune response in a subject, comprising the step of administering to the subject a composition that includes at least a portion of at least one papillomavirus transforming protein and a Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

In yet another embodiment, the invention is a method of stimulating an immune response in a subject, comprising the step of administering to the subject a composition that includes at least a portion of at least one papillomavirus capsid protein and a Toll-like Receptor 5 agonist, wherein the Toll-like Receptor 5 agonist is at least one member selected from the group consisting of SEQ ID NO: 28 (R0), SEQ ID NO: 29 (R3), SEQ ID NO: 30 (R3D0), SEQ ID NO: 31 (D3N), SEQ ID NO: 32 (D3NCs) and SEQ ID NO: 33 (D1).

An additional embodiment of the invention is a method of stimulating an immune response in a subject, comprising the step of administering to the subject a composition that includes at least one Toll-like Receptor agonist and at least a portion of at least one papillomavirus tumor suppressor binding protein, wherein the Toll-like Receptor agonist and the papillomavirus tumor suppressor binding protein are associated with a particle.

In still another embodiment, the invention is a method of stimulating an immune response in a subject, comprising the step of administering to the subject a composition that includes at least one Toll-like Receptor agonist and at least a portion of at least one papillomavirus transforming protein, wherein the Toll-like Receptor agonist and the papillomavirus transforming protein are associated with a particle.

In yet another embodiment, the invention is a method of stimulating an immune response in a subject, comprising the step of administering to the subject a composition that includes at least one Toll-like Receptor agonist and at least a portion of at least one papillomavirus capsid protein, wherein the Toll-like Receptor agonist and the papillomavirus capsid protein are associated with a particle.

The methods and compositions of the invention can be employed to stimulate an immune response, in particular, a protective immune response in a subject. Advantages of the claimed invention include cost effective methods and compositions that can be produced in relatively large quantities and employed in relatively low doses that maximize an immunogenic response and minimize adverse side effects, without the use of adjuvants. The claimed compositions and methods can be employed to prevent, treat and manage disease associated with or consequent to viral infection and, thereby, avoid serious illness and death consequent to influenza infection or exposure.

BRIEF DESCRIPTION OF THE FIGURES

FIG. 7 depicts virus titers measured in the nasal wash of ferrets. Nasal wash samples were collected on days 3 and 5 post infection from animals immunized with buffer alone (placebo), STF2R3.HA1-2 VN (R3.HA1-2 VN) (SEQ ID NO: 452) or STF2R3.2x.HA1-2 VN (R3.2xHA1-2 VN) (SEQ ID NO: 455). Group mean titers±SE are depicted.

FIG. 8A depicts temperatures measured on study day 0, 2 hr post-immunization with the indicated dose of STF2.4xM2e (SEQ ID NO: 457). Mean±SD increases for each group of 6 rabbits are depicted. Baseline temperatures are taken from the group receiving buffer alone and were 102.5° F. FIG. 8B depicts food consumption was monitored from day 0 to day 1. Data is presented as mean food consumption±standard deviation for 6 rabbits per group.

FIGS. 10A-10H depict relative reactogenicity for the STF2.HA1-2 (SEQ ID NO: 451), STF2R3.HA1-2 (SEQ ID NO: 452) and the STF2R3.2x.HA1-2 VN (SEQ ID NO: 455) constructs. Groups of 6 New Zealand White rabbits were immunized with the indicated dose of: the STF2.HA1-2 VN (native) (SEQ ID NO: 451), STF2R3.HA1-2 VN (R3) (SEQ ID NO: 452), STF2R3.2x.HA1-2 VN (R3 2x) (SEQ ID NO: 455) protein or the formulation buffer alone. Sera were harvested 21 days post the priming immunization and assessed for HA specific IgG by ELISA. IgG titers, reported in µg/ml IgG, are depicted in FIG. 10A. Titers shown are for individual sera, group means are indicated with a bar. To allow for comparison to the 'native' construct, group means±3 SD for food consumption, temperature and CRP levels are plotted against IgG levels for STF2.HA1-2 (SEQ ID NO: 451) and STF2R3.HA1-2 (SEQ ID NO: 452) in FIGS. 10A-10D and for STF2.HA1-2 (SEQ ID NO: 451) and STF2R3.2x.HA1-2 (SEQ ID NO: 455) in FIGS. 10E-10H.

FIG. 17A depicts food consumption was monitored from day 0 to day 1. Data is presented as mean food consumption±standard deviation for 6 rabbits per group. FIG. 17B depicts CRP levels were measured 24 hours after the immunization. Data is presented as mean CRP levels±standard deviation for 6 rabbits per group.

FIG. 19A depicts CRP levels were measured 24 hours after the immunization. Data is presented as mean CRP levels+standard deviation for 6 rabbits per group. FIG. 19B depicts food consumption was monitored from day 0 to day 1. Data is presented as mean food consumption±standard deviation for 6 rabbits per group.

FIG. 22A depicts body Temperature (measured 6 hours after immunization on Day 0, degrees F.). FIG. 22B depicts food Consumption (in g) measured between Days 0 and 1. FIG. 22C depicts C reactive protein from serum at 24 hours (µg/mL). All data shown are group means±standard deviation.

FIG. 24A depicts specific IgG vs. Body temperature. FIG. 24B depicts specific IgG vs. Food Consumption. FIG. 24C depicts specific IgG vs. C reactive protein (CRP). All results are shown as group means±standard deviations.

FIG. 34 depicts the effect of STF2.HA1 SI on body temperature. Rabbits were immunized i.m. with the indicated dose of STF2.HA1 SI. F147 buffer is represented as 0. Temperature was measured rectally at 6 hours post-immunization. Data are shown as group means plus standard deviation.

FIG. 42A—Control-immunized mice. FIG. 42B—Mice immunized with STF2Δ.RSVG130-230 (SEQ ID NO: 621). FIG. 42C—Mice immunized with STF2Δ.RSVG130-230 (SEQ ID NO: 621). ELISA plates were coated with RSVG peptide HPEVFNFVPCSICSNNPTCWAICKRI (SEQ ID NO: 627)

Figures 44A, 44B:
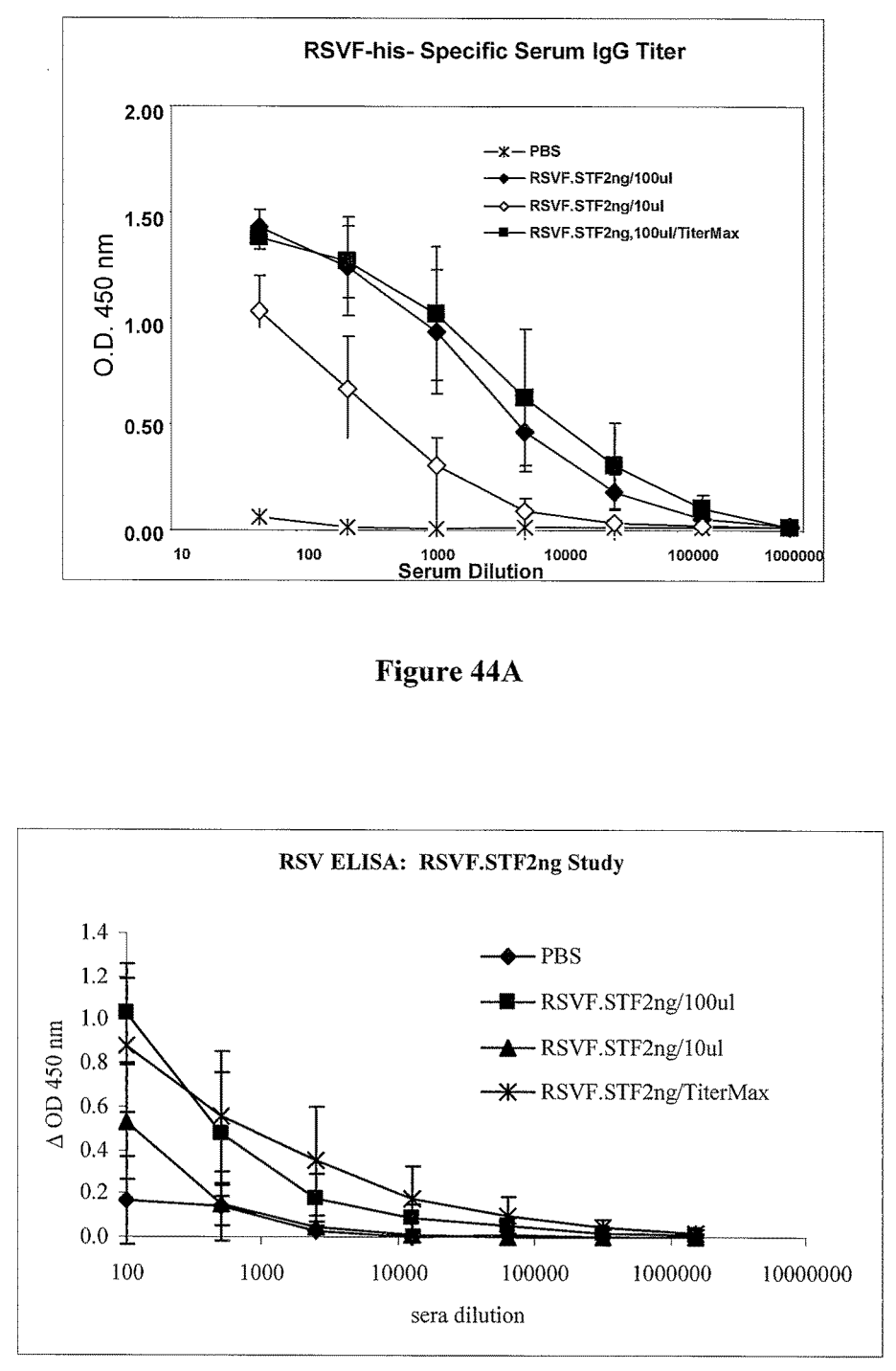

FIGS. 44A-44B depict the IgG antibody response to RSVF.STF2His6 (SEQ ID NO: 615) in Immunogenicity Study #3 in a whole cell ELISA assay.

FIG. 46A—IFNγ (primary). FIG. 46B—IL-4 (primary). FIG. 46C—IFNγ (boost). FIG. 46D—IL-5 (boost).

FIG. 51 depicts dengue neutralizing antibodies elicited following immunization with STF2Δ.DEN2EIII+ protein (SEQ ID NO: 630). As determined by PRNT assay.

FIG. 60 depicts the domains (D0, D1, D2, D3) of a flagellin construct (SEQ ID NO: 29) and a fusion protein that includes, in sequence, the amino-domain 0, the amino-domain 1, the amino-domain 2, the carboxy-domain 2, the carboxy-domain 1 and the carboxy-domain 0 of the flagellin. Two antigens (Ag) are in the fusion protein. An antigen is fused between the amino-domain 2 and the carboxy-domain 2 of the flagellin construct. Another antigen is fused to the carboxy-terminal amino acid of the Domain 0 of the flagellin construct. The flagellin construct is referred to herein as "the R3-2xAg construct."

FIG. 65 depicts disulfide binds in an RSV F protein (Smith, et al., Prot. Eng. 15:365-371 (2001)).

FIG. 66 depicts an RSV G protein (SEQ ID NO: 544).

DETAILED DESCRIPTION OF THE INVENTION

Figure 1:
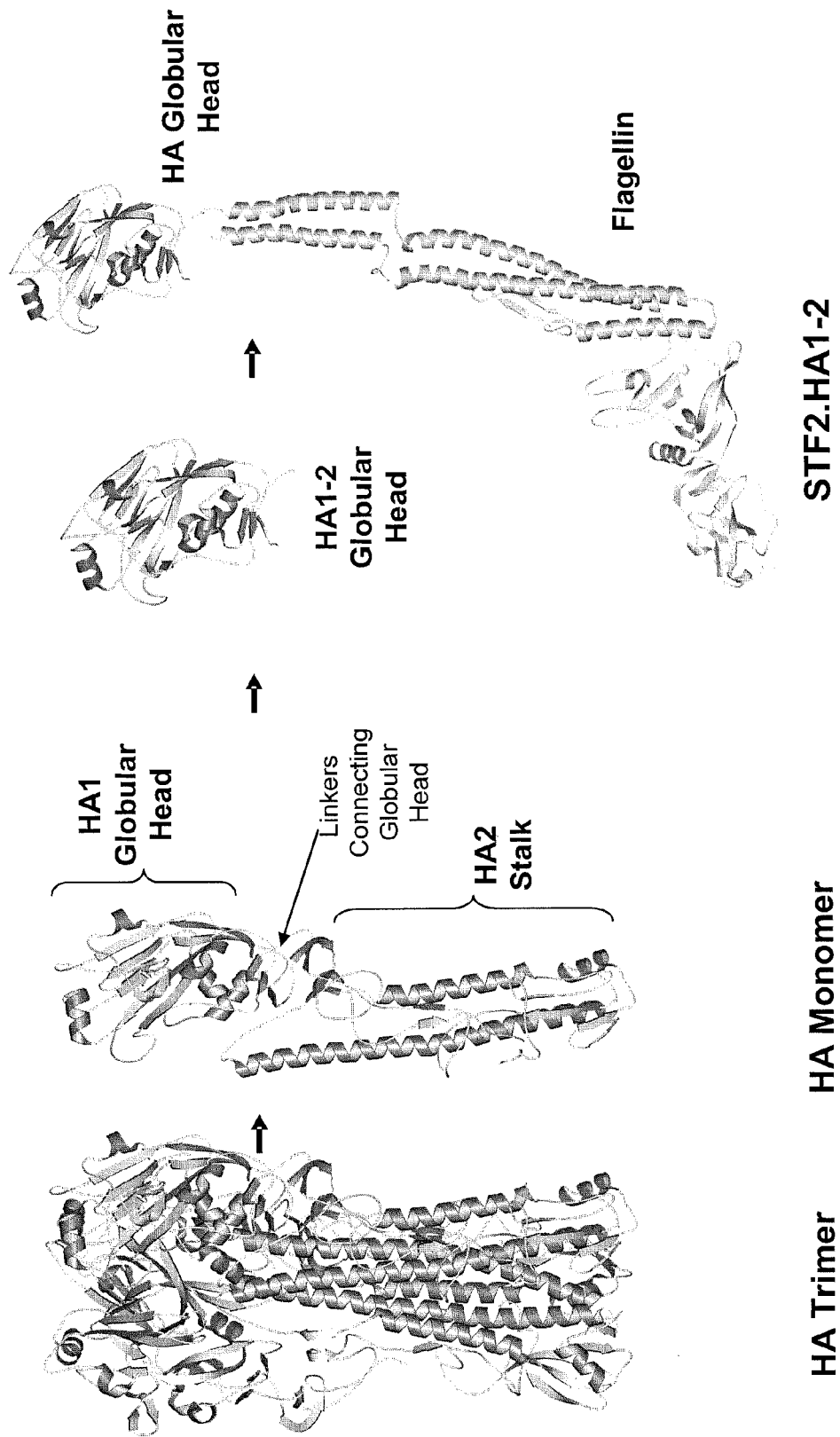
FIG. 1 depicts a schematic of the STF2.HA1-2 fusion protein.

The features and other details of the invention, either as steps of the invention or as combinations of parts of the invention, will now be more particularly described and pointed out in the claims. It will be understood that the particular embodiments of the invention are shown by way of illustration and not as limitations of the invention. The principle features of this invention can be employed in various embodiments without departing from the scope of the invention.

The invention is generally directed to compositions that include viral antigens, such as influenza viral antigens (e.g., hemagglutinin (HA) protein, matrix 2 (M2) protein, neuraminidase), respiratory synctial virus (RSV) antigens (e.g., fusion protein, attachment glycoprotein), papillomaviral antigens (e.g., human papilloma virus (HPV), such as an E6 protein, E7 protein, L1 protein, L2 protein) and flavivirus viral antigens (e.g., Dengue viral antigens, West Nile viral antigens), fusion proteins that include the viral antigens and methods of stimulating an immune response, such as a protective immune response, in a subject employing the compositions described herein.

In an embodiment, the invention is an amino acid sequence having at least about 50.0% identity to a contiguous amino acid sequence as set forth in SEQ ID NO: 29 (an R3 construct), including any insertions or deletions from SEQ ID NO: 29, wherein the isolated amino acid sequence activates a Toll-like Receptor 5 (TLR5). Amino acid sequences that have, for example, at least about 50.0%, at least about 60.0%, at least about 70.0%, at least about 80.0%, at least about 85.0%, at least about 88.0%, at least about 90.0%, at least about 95.0%, at least about 98.0% or at least about 99.0% identity to SEQ ID NO: 29 can be employed in the compositions, fusion proteins and methods of the invention. Exemplary amino acid sequences that have at least about 50.0% identity to SEQ ID NO: 29 include SEQ ID NOs: 770-775.

At least one amino acid residue of SEQ ID NO: 29 selected from the group consisting of 84, 91, 95, 322 and 326 can be substituted with an amino acid other than the naturally occurring amino acid, such as at least one member selected from the group consisting of alanine, serine, glycine, aspartic acid, glutamic acid and lysine. It is believed that the amino acids substituted in the flagellin constructs described herein are involved in interactions (e.g., binding) to TLR5.

"Contiguous," as used herein in reference to amino acid sequences that have identity to the amino acid sequences described herein that activate Toll-like Receptor 5 (e.g., SEQ ID NOs: 29, 30, 31, 32 and 33), refers to an amino acid sequence that does not have any insertions or deletions in any part of the amino acid sequence that shares the percent identity. For example, an amino acid sequence that has at least 50% identity to SEQ ID NO: 29 would not have a gap (i.e., a deletion) in the amino acid sequence when compared to SEQ ID NO: 29 nor would the amino acid sequence have additional amino acids (i.e., an insertion) when compared to SEQ ID NO: 29.

"Activates," when referring to an amino acid sequence or a fusion protein, means that the amino acid sequence, fusion protein or component of the fusion protein (e.g., an amino acid sequence) stimulates a response associated with a TLR 5, for example, host inflammatory responses (Smith, K. D., et al., *Nature Immunology* 4:1247-1253 (2003)), such as Interleukin-8 (IL-8) production, tumor necrosis factor (TNF) production and NK-κB activation, as described herein.

Compositions of the invention that include portions of flagellin referred to herein, for example, as "R3," "R32x," "R3D0," "D3N," "D3NCs" and "D1," have the advantage of, when used in combination (e.g., as a fusion protein) with different antigens (e.g., influenza antigens, such as HA antigen, swine H1N1 antigens, HVP antigens, RSV antigen, Dengue viral antigens), and administered to a subject achieve a larger therapeutic window, which can minimize or eliminate side effects at higher doses when compared to use of full length flagellin. For example, fusion proteins that include portions of flagellin referred to herein as "R3" and "R32x" can be administered to human subjects with minimal side effects at doses that would otherwise result in unwanted side effects if made with full length flagellin. In addition, fusion proteins that include portions of flagellin referred to as "R3" and "R32x" induce strong immune responses that can result in protective immunity at relatively lower (e.g., about 1 μg to about 1.5 μg) and higher (e.g., about 16 μg to about 20 μg) doses when employed as a vaccine.

This combination of equal or higher potencies compared to fusion proteins made with full length flagellin and lower side effects, improve and enlarge the therapeutic window of compositions of the invention that can be employed as vaccines. Fusion proteins of the invention constructed with portions of flagellin of the invention (e.g., R3 and R32x) and antigens permits the use of higher cumulative doses of fusion proteins either in formulations that contain a single fusion protein or several similar or dissimilar fusion proteins in combination. These improved attributes are particularly beneficial when making vaccines like the seasonal influenza vaccine where multiple antigens (e.g., 3, 4 different HA antigens from different influenza strains) would need to be combined to provide protective immunity to the multiple influenza strains without reaching a cumulative dose of flagellin that results in unwanted side effects.

R3 constructs can be fused to at least one antigen described herein. Exemplary R3 constructs (also referred to herein as "R3 flagellin constructs" or "R3 form of flagellin") fused to, for example, an influenza viral HA antigen (SEQ ID NO: 499) are shown below. Exemplary R3 constructs include SEQ ID NOs: 29, 699, 700 and 701. The HA antigen sequence is underlined.

```
STF2fliC.R3HA1-2(SI)                          (SEQ ID NO: 500)
MAQVINTNSLSLLTQNNLNKSQSALGTAIERLSSGLRINSAKDDAAGQAIANRFTANI
KGLTQASRNANDGISIAQTTEGALNEINNNLQRVRELAVQSANSTNSQSDLDSIQAEI
TQRLNEIDRVSGQTQFNGVKVLAQDNTLTIQVGANDGETIDIDLKQINSQTLGLDTLN
VQQKYKVSDTAATVTGKGIAPLQLGNCSVAGWILGNPECELLISRESWSYIVEKPNPE
NGTCYPGHFADYEELREQLSSVSSFERFEIFPKESSWPNHTTTGVSASCSHNGESSFY
KNLLWLTGKNGLYPNLSKSYANNKEKEVLVLWGVHHPPNIGDQRALYHKENAYVSVVS
SHYSRKFTPEIAKRPKVRDQEGRINYYWTLLEPGDTIIFEANGNLIAPRYAFALSRGF
GSGIINSNADLTEAKAALTAAGVTGTASVVKMSYTDNNGKTIDGGLAVKVGDDYYSAT
QNKDGSISINTTKYTADDGTSKTALNKLGGADGKTEVVSIGGKTYAASKAEGHNFKAQ
PDLAEAAATTTENPLQKIDAALAQVDTLRSDLGAVQNRFNSAITNLGNTVNNLTSARS
RIEDSDYATEVSNMSRAQILQQAGTSVLAQANQVPQNVLSLLR STF2fljBR3.HA1-2(SI)                          (SEQ ID NO: 465)
MAQVINTNSLSLLTQNNLNKSQSALGTAIERLSSGLRINSAKDDAAGQAIANRFTANI
KGLTQASRNANDGISIAQTTEGALNEINNNLQRVRELAVQSANSTNSQSDLDSIQAEI
TQRLNEIDRVSGQTQFNGVKVLAQDNTLTIQVGANDGETIDIDLKQINSQTLGLDSLN
VQKAYDVKDTAVTTKAKGIAPLQLGNCSVAGWILGNPECELLISRESWSYIVEKPNPE
NGTCYPGHFADYEELREQLSSVSSFERFEIFPKESSWPNHTTTGVSASCSHNGESSFY
KNLLWLTGKNGLYPNLSKSYANNKEKEVLVLWGVHHPPNIGDQRALYHKENAYVSVVS
SHYSRKFTPEIAKRPKVRDQEGRINYYWTLLEPGDTIIFEANGNLIAPRYAFALSRGF
GSGIINSAVVSADAKNALIAGGVDATDANGAELVKMSYTDKNGKTIEGGYALKAGDKY
YAADYDEATGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITNLGNTVNNL
SEARSRIEDSDYATEVSNMSRAQILQQAGTSVLAQANQVPQNVLSLLA
```

-continued

*E.coliR3.HA1-2(SI)* (SEQ ID NO: 501)

MAQVINTNSLSLITQNNINKNQSALSSSIERLSSGLRINSAKDDAAGQAIANRFTSNI
KGLTQAARNANDGISVAQTTEGALSEINNNLQRIRELTVQASTGTNSDSDLDSIQDEI
KSRLDEIDRVSGQTQFNGVNVLAKDGSMKIQVGANDGQTITIDLKKIDSDTLGLNGFN
VNGSGTIANKAATI<u>SDKGIAPLQLGNCSVAGWILGNPECELLISRESWSYIVEKPNPE
NGTCYPGHFADYEELREQLSSVSSFERFEIFPPKESSWPNHTTTGVSASCSHNGESSFY
KNLLWLTGKNGLYPNLSKSYANNKEKEVLVLWGVHHPPNIGDQRALYHKENAYVSVVS
SHYSRKFTPEIAKRPKVRDQEGRINYYWTLLEPGDTIIFEANGNLIAPRYAFALSRGF
GSGIINSSVTMGGTTYNFKTGADAGAATANAGVSFTDTASKETVLNKVATAKQGTAVA</u>
ANGDTSATITYKSGVQTYQAVFAAGDGTASAKYADNTDVSNATATYTDADGEMTTIGS
YTTKYSIDANNGKVTVDSGTGTGKYAPKVGAEVYVSANGTLTTDATSEGTVTKDPLKA
LDEAISSSIDKFRSSLGAIQNRLDSAVTNLNNTTTNLSEAQSRIQDADYATEVSNMSKA
QIIQQAGNSVLAKANQVPQQVLSLLQG

*Bacillus subtilis.R3.HA1-2(SI)* (SEQ ID NO: 502)

MRINHNIAALNTSR

```
                       410        420        430        440        450
                        |          |          |          |          |
fliCR3HA1_2SI   FALSRGFGSGIINSNADL---------TEAKAALTAAGVTGTAS-----
fljBR3HA1_2SI   FALSRGFGSGIINSAVVS---------ADAKNALIAGGVDATDANGAE-
EcoliR3HA1_2SI  FALSRGFGSGIINSSVTMGGTTYNFKTGADAGAATANAGVSFTDTASKET
BsubR3HA1_2SI   FALSRGFGSGIINSWADA--------------------------------
                **************  .

460        470        480        490        500
                        |          |          |          |          |
fliCR3HA1_2SI   VVKMSYTDNNGKTIDGG----------------LAVKVGDDYYSATQNK
fljBR3HA1_2SI   LVKMSYTDKNGKTIEGG----------------YALKAGDKYYAADYDE
EcoliR3HA1_2SI  VLNKVATAKQGTAVAANGDTSATITYKSGVQTYQAVFAAGDGTASAKYAD
BsubR3HA1_2SI   --------------------------------------------------

510        520        530        540        550
                        |          |          |          |          |
fliCR3HA1_2SI   D-GSISINTTKYTADDGTSKTALN-----KLGGADGKTEVVSIGGKTYAA
fljBR3HA1_2SI   ATGAIKAKTTSYTAADGTTKTAAN-----QLGGVDGKTEVVTIDGKTYNA
EcoliR3HA1_2SI  N-TDVSNATATYTDADGEMTTIGSYTTKYSIDANNGKVTVDSGTGTGKYA
BsubR3HA1_2SI   --DDATNKPAGYYDAG-------------------------GKVIAS
                  . .:  *   .                           *.   :

560        570        580        590        600
                        |          |          |          |          |
fliCR3HA1_2SI   SKAEGHNFKAQP----DLAEAAATTTENPLQKIDAALAQVDTLRSDLGAV
fljBR3HA1_2SI   SKAAGHDFKAQP----ELAEAAAKTTENPLQKIDAALAQVDALRSDLGAV
EcoliR3HA1_2SI  PKVGAEVYVSANGTLTTDATSEGTVTKDPLKALDEAISSIDKFRSSLGAI
BsubR3HA1_2SI   EKLAADSKVTKG----IDISSSAKAASSALTTIKTAIDTVSSERAKLGAV
                 *   ..   :       :  ...:...*  :. *:  :.   *:.***:

610        620        630        640        650
                        |          |          |          |          |
fliCR3HA1_2SI   QNRFNSAITNLGNTVNNLTSARSRIEDSDYATEVSNMSRAQILQQAGTSV
fljBR3HA1_2SI   QNRFNSAITNLGNTVNNLSEARSRIEDSDYATEVSNMSRAQILQQAGTSV
EcoliR3HA1_2SI  QNRLDSAVTNLNNTTTNLSEAQSRIQDADYATEVSNMSKAQIIQQAGNSV
BsubR3HA1_2SI   QNRLEHTINNLGTSSENLTSAESRIRDVDMASEMMEYTKNNILTQASQAM
                ***::  ::.**..:   **:.*.***.* * *:*:  :  ::  :*: **.  ::

660
                        |
fliCR3HA1_2SI   LAQANQVPQNVLSLLR-  (SEQ ID NO: 500)
fljBR3HA1_2SI   LAQANQVPQNVLSLLA-  (SEQ ID NO: 465)
EcoliR3HA1_2SI  LAKANQVPQQVLSLLQG  (SEQ ID NO: 501)
BsubR3HA1_2SI   LAQANQ-----------  (SEQ ID NO: 502)
                **:***
```

Alignment data:
Alignment length: 667
Identity (*): 323 is 48.43%
Strongly similar (:): 75 is 11.24%
Weakly similar (.): 44 is 6.60%
Different: 225 is 33.73%
Sequence 0001: fliCR3HA1_2SI (623 residues).
Sequence 0002: fljBR3HA1_2SI (628 residues).
Sequence 0003: EcoliR3HA1_2SI (665 residues).
Sequence 0004: BsubR3HA1_2SI (526 residues).

The compositions and fusion proteins of the invention that activate a TLR5 can further include components that activate at least one member selected from the group consisting of a TLR1, TLR2, TLR3, TLR4, TLR6, TLR7, TLR8, TLR9, TLR10, TLR11 and TLR12. Bacterial lipopeptide activates TLR1; Pam3Cys, Pam2Cys activate TLR2; dsRNA activates TLR3; LBS (LPS-binding protein) and LPS (lipopolysaccharide) activate TLR4; imidazoquinolines (anti-viral compounds and ssRNA) activate TLR7; and bacterial DNA (CpG DNA) activates TLR9. TLR1 and TLR6 require heterodimerization with TLR2 to recognize ligands (e.g., TLR agonists, TLR antagonists). TLR1/2 are activated by triacyl lipoprotein (or a lipopeptide, such as Pam3Cys), whereas TLR6/2 are activated by diacyl lipoproteins (e g., Pam2Cys), although there may be some cross-recognition. In addition to the natural ligands, synthetic small molecules including the imidazoquinolines, with subclasses that are specific for TLR7 or TLR8 can activate both TLR7 and TLR8. There are also synthetic analogs of LPS that activate TLR4, such as monophosphoryl lipid A [MPL].

Pathogen-associated molecular patterns (PAMPs), such as a flagellin or a bacterial lipoprotein, refer to a class of molecules (e.g., protein, peptide, carbohydrate, lipid, lipopeptide, nucleic acid) found in microorganisms that, when bound to a pattern recognition receptor (PRR), can trigger an innate immune response. The PRR can be a Toll-like Receptor (TLR).

TLRs are the best characterized type of Pattern Recognition Receptor (PRR) expressed on antigen-presenting cells (APC). APC utilize TLRs to survey the microenvironment and detect signals of pathogenic infection by engaging the cognate ligands of TLRs, PAMPs. TLR activation triggers the innate immune response, the first line of defense against pathogenic insult, manifested as release of cytokines, chemokines and other inflammatory mediators; recruitment of phagocytic cells; and important cellular mechanisms which lead to the expression of costimulatory molecules and efficient processing and presentation of antigens to T-cells.

Toll-like Receptors were named based on homology to the *Drosophila melangogaster* Toll protein. Toll-like Receptors (TLR) are type I transmembrane signaling receptor proteins characterized by an extracellular leucine-rich repeat domain and an intracellular domain homologous to an interleukin 1 receptor. Toll-like Receptors include TLR1, TLR2, TLR3, TLR4, TLR5, TLR6, TLR7, TLR 8, TLR9, TLR10, TLR11 and TLR12.

The binding of PAMPs to TLRs activates innate immune pathways. Target cells can result in the display of co-stimulatory molecules on the cell surface, as well as antigenic peptide in the context of major histocompatibility complex molecules. The compositions and proteins of the invention include a TLR (e.g., TLR5), which promote differentiation and maturation of the APC, including production and display of co-stimulatory signals. The proteins of the invention can be internalized by interaction with TLR and processed through the lysosomal pathway to generate antigenic peptides, which are displayed on the surface in the context of the major histocompatibility complex.

The compositions and fusions proteins of the invention can trigger cellular events resulting in the expression of costimulatory molecules, secretion of critical cytokines and chemokines; and efficient processing and presentation of antigens to T-cells. As discussed above, TLRs recognize PAMPs including bacterial cell wall components (e.g., bacterial lipoproteins and lipopolysaccharides), bacterial DNA sequences that contain unmethylated CpG residues and bacterial flagellin that act as initiators of the innate immune response and gatekeepers of the adaptive immune response (Medzhitov, R., et al., *Cold Springs Harb. Symp. Quant. Biol.* 64:429 (1999); Pasare, C., et al., *Semin, Immunol* 16:23 (2004); Medzhitov, R., et al., *Nature* 388:394 (1997); Barton, G. M., et al., *Curr. Opin. Immunol* 14:380 (2002); Bendelac, A., et al., *J. Exp. Med.* 195:F19 (2002)).

The compositions and fusions proteins of the invention can trigger signal transduction pathways of the innate and adaptive immune system of the subject to thereby stimulate the immune system of a subject to generate antibodies and protective immunity to the antigen component of the composition, which, in turn may prevent infection by a virus, such as influenza virus, a respiratory syncytial virus, a papillomavirus and a flavivirus, to thereby treat the subject or prevent the subject from disease, illness and, possibly, death.

In another embodiment, the invention is an amino acid sequence having at least about 50.0% identity to a contiguous amino acid sequence as set forth in SEQ ID NO: 30 (an R3D0 construct), including any insertions or deletions from SEQ ID NO: 30, wherein the isolated amino acid sequence activates a Toll-like Receptor 5. Exemplary amino acid sequences that have at least about 50.0% identity to SEQ ID NO: 30 include SEQ ID NOs: 776-781.

At least one amino acid residue of SEQ ID NO: 30 selected from the group consisting of 39, 46, 50, 277 and 281 can be substituted with an alanine residue. Substitution of amino acid residues of the amino acid sequences and fusion proteins described herein are in regions of the amino acid sequences and fusion proteins that maintain Toll-like Receptor 5 binding and hence activation of the Toll-like Receptor 5 by the amino acid sequence and fusion protein of the invention.

In an additional embodiment, the invention is an amino acid sequence having at least about 60.0% identity to a contiguous amino acid sequence as set forth in SEQ ID NO: 31 (an D3N construct), including any insertions or deletions from SEQ ID NO: 31, wherein the isolated amino acid sequence activates a Toll-like Receptor 5. Exemplary amino acid sequences that have at least about 60.0% identity to SEQ ID NO: 31 include SEQ ID NOs: 782-787.

At least one amino acid residue of SEQ ID NO: 31 selected from the group consisting of 39, 46, 50, 277 and 281 can be substituted with an alanine residue.

In still another embodiment, the invention is an amino acid sequence having at least about 60.0% identity to a contiguous amino acid sequence as set forth in SEQ ID NO: 32 (an D3NCs construct), including any insertions or deletions from SEQ ID NO: 32, wherein the isolated amino acid sequence activates a Toll-like Receptor 5. Exemplary amino acid sequences that have at least about 60.0% identity to SEQ ID NO: 32 include SEQ ID NOs: 788-793.

At least one amino acid residue of SEQ ID NO: 32 selected from the group consisting of 39, 46, 50, 277 and 281 can be substituted with an alanine residue.

In another embodiment, the invention is an amino acid sequence having at least about 60.0% identity to a contiguous amino acid sequence as set forth in SEQ ID NO:33 (an D1 construct), including any insertions or deletions from SEQ ID NO: 33, wherein the isolated amino acid sequence activates a Toll-like Receptor 5. Exemplary amino acid sequences that have at least about 60.0% identity to SEQ ID NO: 33 include SEQ ID NOs: 794-799.

At least one amino acid residue of SEQ ID NO: 33 selected from the group consisting of 38, 45, 49, 139 and 143 is substituted with an alanine residue.

In yet another embodiment, the invention is an amino acid sequence as set forth in at least one member selected from the group consisting of SEQ ID NO: 29 (R3), SEQ ID NO: 30 (R3D0), SEQ ID NO: 31 (D3N), SEQ ID NO: 32 (D3NCs) and SEQ ID NO: 33 (D1).

In a further embodiment, the invention is a fusion protein comprising, in sequence, at least one amino acid sequence as set forth in SEQ ID NO: 28 (R0 construct) and at least a portion of at least one antigen, wherein at least one amino acid residue of SEQ ID NO: 28 selected from the group consisting of 39, 46, 50, 378 and 382 is substituted with an alanine residue and wherein the fusion protein activates a Toll-like Receptor 5.

Figure 55:
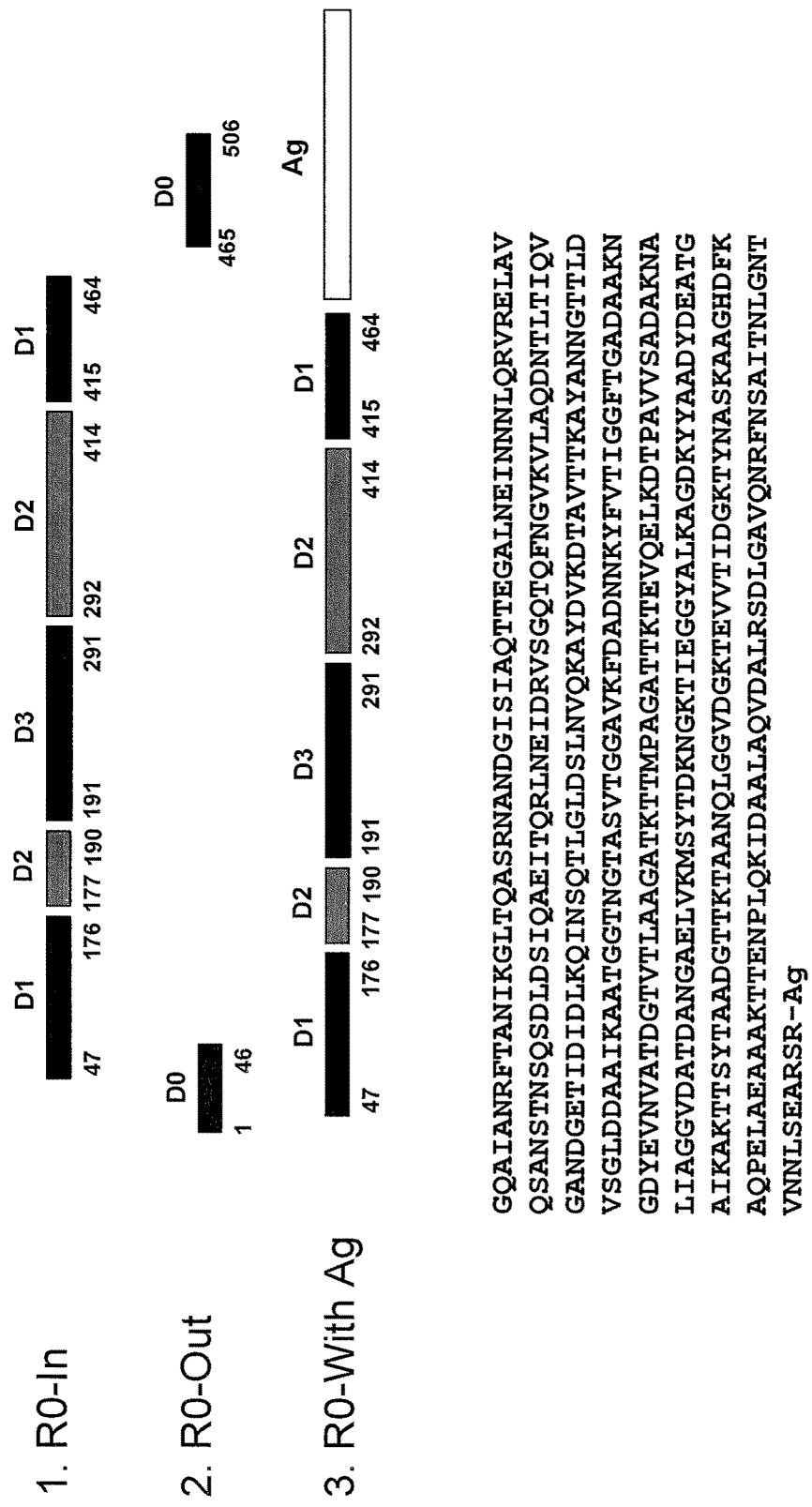
FIG. 55 depicts the domains (D0, D1, D2, D3) of a flagellin construct (SEQ ID NO: 28) and a fusion protein that includes, in sequence, the amino-domain 1, the amino-domain 2, domain 3, the carboxy-domain 2 and the carboxy-domain 1 of flagellin, fused to an antigen (Ag). The flagellin construct is referred to herein as "an R0 construct."

FIG. 55 depicts the domains (D0, D1, D2, D3) of a flagellin construct (e.g., a flagellin component of a fusion protein) and a fusion protein (SEQ ID NO: 28) that includes, in sequence, the amino-domain 1 (also referred to herein as "D1N"), the amino-domain 2 (also referred to herein as "D2N"), domain 3 (also referred to herein as "D3"), the carboxy-domain 2 (also referred to herein as "D2C") and the carboxy-domain 1 (also referred to herein as "D1C"), fused to an antigen (Ag). The flagellin component of the fusion protein depicted in FIG. 55 lacks the amino- and carboxy-D0 domains of flagellin (also referred to herein as "D0N" and "D0C," respectively) and is referred to herein as an "R0 construct" or "R0 form of flagellin" or "R0 flagellin construct." "R0 (Replace Domain 0) construct," as used herein, means that Domain 0 of the flagellin has been Replaced with an antigen described herein.

"Fusion proteins," as used herein, refers to a protein that is generated by the joining of two components (also referred to herein as "fused" or "linked") (e.g., an amino acid sequence that activates a TLR5 and at least a portion of a viral antigen). Fusion proteins of the invention can be generated by recombinant DNA technologies or by chemical conjugation of the components of the fusion protein. Recombinant DNA technologies and chemical conjugation techniques are well established procedures and known to one of skill in the art. Exemplary techniques to generate fusion proteins that include Toll-like Receptor agonists are described herein and in U.S. application Ser. No. 11/714,684, now abandoned, and Ser. No. 11/714,873, now U.S. Pat. No. 8,420,102, Issued Apr. 16, 2013, the teachings of both of which are hereby incorporated by reference in their entirety.

In an embodiment, a carboxy-terminus of the antigen component of the fusion protein is fused to an amino terminus of the amino acid sequence that activates a TLR5 or a flagellin component of the fusion protein. In another embodiment, an amino-terminus of the antigen component of the fusion protein is fused to a carboxy-terminus of the amino acid sequence that activates a TLR5 or a flagellin component of the fusion protein.

"Component," as used herein in reference to the fusion proteins described herein, refers to constituents of the fusion protein. For example, a "viral antigen component," as used herein, refers to part of the viral antigen that includes at least a portion or the entirety of a viral antigen protein. Likewise, for example, a "Toll-like Receptor agonist component," as used herein, refers to at least part of the fusion protein that includes at least a portion of a Toll-like Receptor agonist. The Toll-like Receptor agonist component can be a flagellin component, including, for example, an R0 construct, an R3 construct, an R3D0 construct, a D3N construct, a D3NCs construct and a D1 construct. "Flagellin component," as used herein, refers to at least part of the protein that includes at least a portion of or the entirety of a flagellin.

Antigens for use in the fusion proteins of the invention can include at least a portion of at least one viral protein antigen. The viral protein antigen can include at least one member selected from the group consisting of an influenza viral protein antigen (an influenza A viral protein antigen, an influenza B viral protein antigen, an influenza C viral protein antigen), a flaviviral protein antigen (e.g., a West Nile flaviviral protein antigen, a Dengue flaviviral protein antigen), a respiratory synctial viral protein antigen and a papillomaviral protein antigen.

"At least a portion," as used herein in reference to components of the fusion proteins or compositions of the invention, means any part or the entirety of the component. "At least a portion" is also referred to as "fragment."

Influenza antigens for use in the compositions and methods of the invention can include at least one integral membrane protein antigen. The integral membrane protein antigen can include an influenza integral membrane protein antigen, such as at least a portion of at least one member selected from the group consisting of a haemagglutinin membrane protein, a neuraminidase membrane protein and a matrix 2 membrane protein. The integral membrane protein can include at least a portion of at least one haemagglutinin membrane protein, such as at least one member selected from the group consisting of SEQ ID NOs: 228-281, 283-295, 454, 456, 481, 499, 662, 665, 813 and 826-831. The integral membrane protein can include at least a portion of at least one matrix 2 membrane protein (e.g., at least four matrix 2 membrane proteins, such as SEQ ID NO: 485), such as at least one member selected from the group consisting of SEQ ID NO: 296, 298, 300-321, 323-336, 507 and 666.

Fusion proteins of the invention can be designated by the components of the fusion proteins separated by a ".". For example, "STF2R3.HA1-2 PR8" refers to a protein comprising one amino acid sequence of an R3 construct, such as SEQ ID NO: 29, fused to a portion of a hemagglutinin protein, HA1-2 of the Puerto Rican 8 strain. Exemplary fusion proteins of the invention include influenza antigens (SEQ ID NOs: 451-453, 465, 470, 471 and 474); respiratory synctial virus antigens (SEQ ID NOs: 615, 621, 623 and 625); papillomaviral antigens (SEQ ID NOs. 157-180, 187-192, 204-209 and 216-227), flavivirus antigens (SEQ ID NOs: 628, 630, 632 and 634) and fusion proteins described and listed in the Sequence Listing herein.

Fusion proteins of the invention can include, for example, two, three, four, five, six or more amino acid sequences that activate TLR 5, such as portions of flagellin (e.g., SEQ ID NOs: 28-34) or Toll-like Receptor agonists (e.g., at least a portion of flagellin) and two, three, four, five, six or more antigen proteins. When two or more TLR agonists and/or two or more proteins comprise proteins of the invention, they are also referred to as "multimers." For example, a multimer of an M2 protein, such as an influenza or RSV M2 protein, can be SEQ ID NOs: 485 and 551, respectively, which is referred to herein as 4xM2.

The proteins of the invention can further include a linker between at least one component of the fusion protein (e.g., an antigen protein) and at least one other component of the protein (e.g., amino acid sequence that activates a TLR5, a flagellin component) of the composition, a linker (e.g., an amino acid linker) between at least two similar components of the protein (e.g., between two antigens) or any combination thereof. The linker can be between the antigen component and Toll-like Receptor agonist component or flagellin component of a fusion protein. "Linker," as used herein in reference to a protein of the invention, refers to a connector between components of the protein in a manner that the components of the protein are not directly joined. For example, one component of the fusion protein (e.g., amino acid sequence that activates TLR5, a flagellin component) can be linked to a distinct component (e.g., antigen) of the fusion protein. Likewise, at least two or more similar or like components of the fusion protein can be linked (e.g., two amino acid sequences that activate a TLR5, such as two (2) R3 sequences) by a linker; or two antigen components can further include a linker between each antigen.

Additionally, or alternatively, the fusion proteins of the invention can include a combination of a linker between distinct components of the protein and similar or like components of the protein. For example, a fusion protein can comprise at least two TLR agonists, such as flagellin or an R0, R3, R3D0, D3N, D3NCs or D1 constructs, that further includes a linker between, for example, two or more flagellin constructs; at least two antigen protein components that further include a linker between them; a linker between one component of the protein (e.g., a flagellin construct) and another distinct component of the fusion protein, such as the antigen, or any combination thereof.

The linker can be an amino acid linker. The amino acid linker can include synthetic or naturally occurring amino acid residues. The amino acid linker employed in the proteins of the invention can include at least one member selected from the group consisting of a lysine residue, a glutamic acid residue, a serine residue and an arginine residue.

In still another embodiment, the invention is a fusion protein comprising at least one amino acid sequence as set forth in SEQ ID NO: 29 (R3 construct) and at least a portion of at least one antigen, wherein the antigen is between amino acid residues 190 and 191 of SEQ ID NO: 29, and wherein the fusion protein activates a Toll-like Receptor 5.

Figure 56:
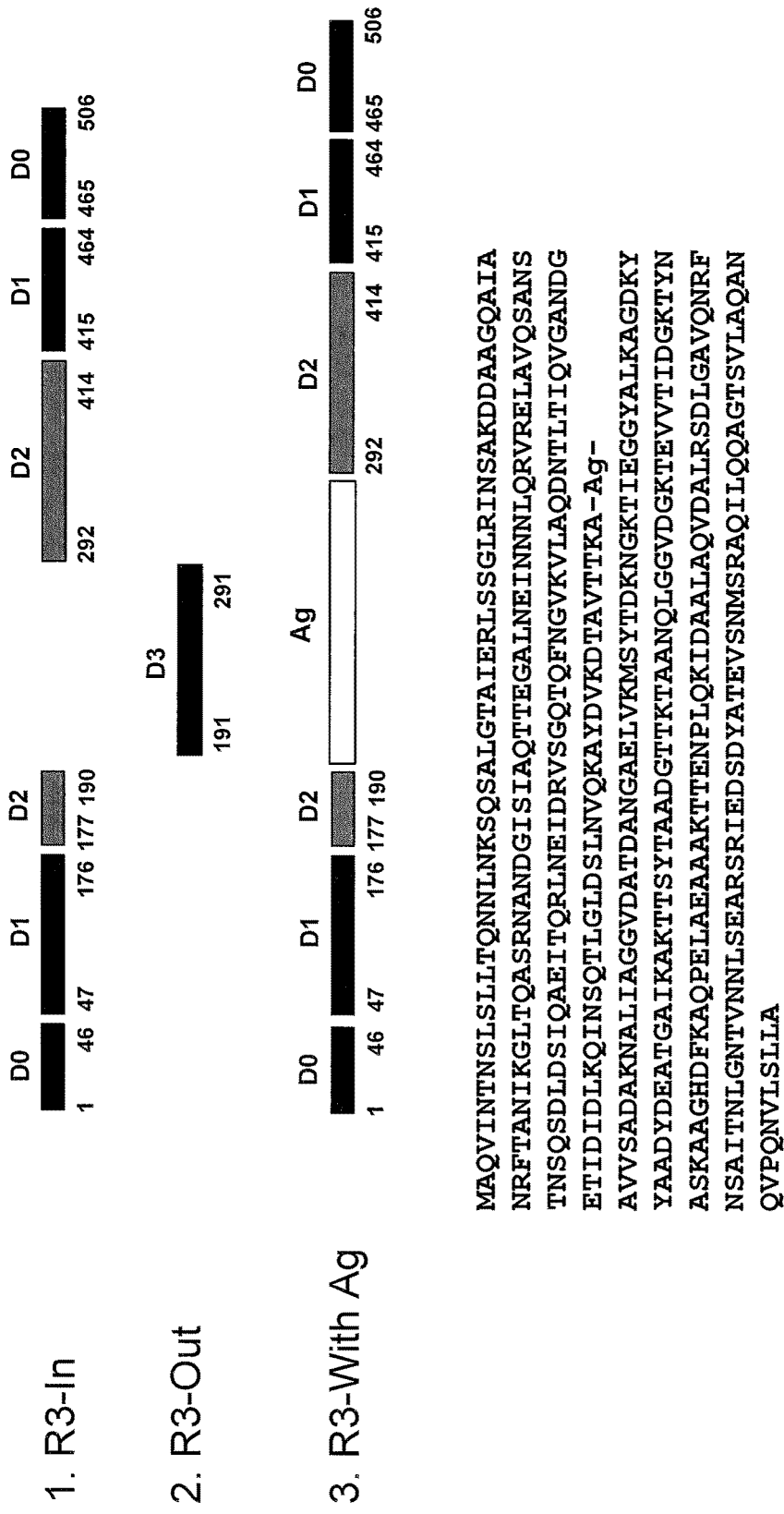
FIG. 56 depicts the domains (D0, D1, D2, D3) of a flagellin construct (SEQ ID NO: 29) and a fusion protein that includes, in sequence, the amino-domain 0, the amino-domain 1, the amino-domain 2, the carboxy-domain 2, the carboxy-domain 1 and the carboxy-domain 0 of flagellin. The antigen (Ag) is inserted between the amino-terminus and carboxy-terminus of domain 2 of the flagellin construct. The flagellin construct is referred to herein as "the R3 construct." SEQ ID NO: 29 is the amino acid sequence of an R3 construct and an D3 construct, which differ by the location of the fused antigen.

FIG. 56 depicts the domains (D0, D1, D2, D3) of a flagellin construct (SEQ ID NO: 29) and a fusion protein that includes, in sequence, the amino-domain 0, the amino-domain 1, the amino-domain 2, the carboxy-domain 2, the carboxy-domain 1 and the carboxy-domain 0 of flagellin. An antigen (Ag) is fused between the amino- and carboxy-domain 2 of the flagellin construct. The flagellin construct of the fusion protein depicted in FIG. 56 lacks the D3 domain of flagellin and is referred to herein as an "R3 construct" or the "R3 form of flagellin" or "R3 flagellin construct." "R3 (Replace Domain 3) construct," as used herein, means that Domain 3 of the flagellin has been Replaced with an antigen describe herein. An amino acid sequence that activates a TLR5 and has at least about 50.0%, at least about 60.0%, at least about 80.0%, at least about 85.0%, at least about 90.0%, at least about 95.0%, at least about 98.0% and at least about 99.0% identity to a contiguous amino acid sequence, without any insertions or deletions, as set forth in SEQ ID NO: 29 can be employed in the compositions, fusion proteins and methods of the invention.

In another embodiment, the invention is a fusion protein comprising, in sequence, at least one amino acid sequence as set forth in SEQ ID NO: 29 (D3 construct) and at least a portion of at least one antigen, wherein the fusion protein activates a Toll-like Receptor 5.

Figure 57:
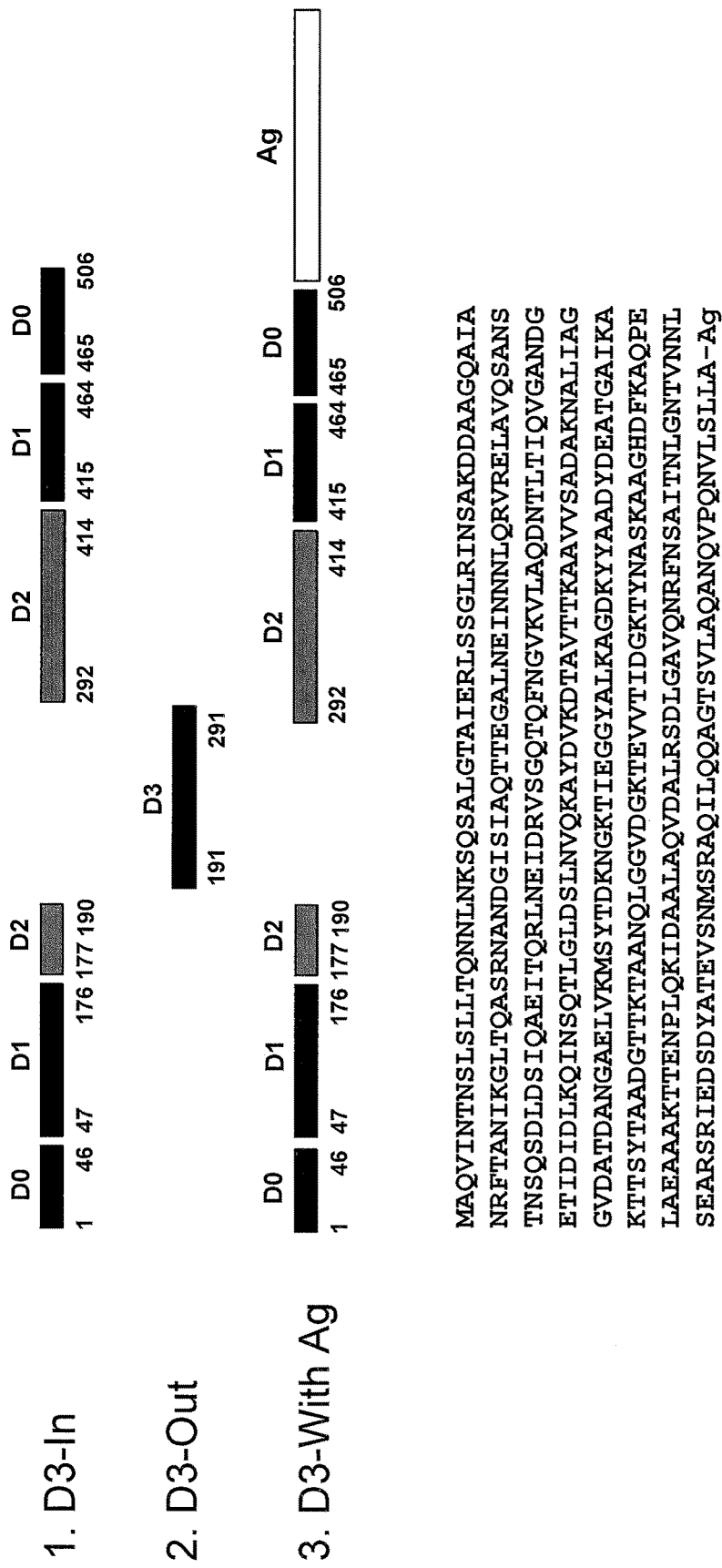
FIG. 57 depicts the domains (D0, D1, D2, D3) of a flagellin construct (SEQ ID NO: 29) and a fusion protein that includes, in sequence, the amino-domain 0, the amino-domain 1, the amino-domain 2, the carboxy-domain 2, the carboxy-domain 1 and the carboxy-domain 0 of flagellin fused to an antigen (Ag). An antigen (Ag) is fused to the terminal amino acid of the carboxy-domain 0 of the flagellin construct. The flagellin construct is referred to herein as "the D3 construct."

FIG. 57 depicts the domains (D0, D1, D2, D3) of an amino acid sequence of a portion of a flagellin (SEQ ID NO: 29) and a fusion protein that includes, in sequence, the amino-domain 0, the amino-domain 1, the amino-domain 2, the carboxy-domain 2, the carboxy-domain 1 and the carboxy-domain 0 of flagellin fused to an antigen (Ag). The antigen is fused to the terminal amino acid of the carboxy-domain 0 of the flagellin construct. The flagellin component of the fusion protein depicted in FIG. 57 lacks the D3 domain of flagellin and is referred to herein as an "D3 construct" or the "D3 form of flagellin" or a "D3 flagellin construct." "D3 construct," as used herein, means that Domain 3 of the flagellin is lacking in the flagellin component and the antigen is linked to the carboxy-terminus of Domain 0 of the flagellin component. An antigen can be fused to the terminal carboxy amino acid of the D3 construct.

In an additional embodiment, the invention is a fusion protein comprising at least one amino acid sequence as set forth in SEQ ID NO: 30 (R3D0 construct) and at least a portion of at least one antigen, wherein the antigen is between amino acid residues 145 and 146 of SEQ ID NO: 30 and the fusion protein activates a Toll-like Receptor 5.

Figure 58:
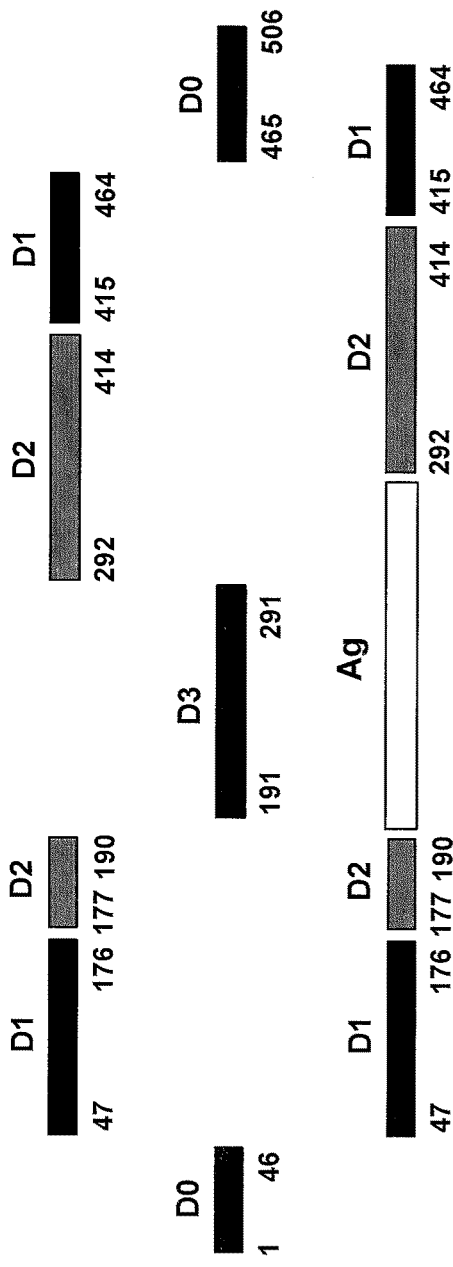
FIG. 58 depicts the domains (D0, D1, D2, D3) of a flagellin construct (SEQ ID NO: 30) and a fusion protein that includes, in sequence, the amino-domain 1, the amino-domain 2, the carboxy-domain 2 and the carboxy-domain 1 of flagellin. An antigen (Ag) is fused between the amino-domain 2 and the carboxy-domain 2 of the flagellin construct. The flagellin construct is referred to herein as "the R3D0 construct."

FIG. 58 depicts the domains (D0, D1, D2, D3) of a flagellin construct (SEQ ID NO: 30) and a fusion protein that includes, in sequence, the amino-domain 1, the amino-domain 2, the carboxy-domain 2 and the carboxy-domain 1 of flagellin. The antigen (Ag) is fused between the amino-domain 2 and the carboxy-domain 2 of flagellin. The flagellin component of the fusion protein depicted in FIG. 58 lacks the D3 domain of flagellin and is referred to herein as an "R3D0 construct" or the "R3D0 form of flagellin" or "R3D0 flagellin construct." "R3D0 construct," as used herein, means that Domain 3 of the flagellin is Replaced with an antigen and Domain 0 is lacking. An amino acid sequence that activates TLR5 and has at least about 50.0%, at least about 60.0%, at least about 80.0%, at least about 85.0%, at least about 90.0%, at least about 95.0%, at least about 98.0% and at least about 99.0% identity to a contiguous amino acid sequence, without any insertions or deletions, as set forth in SEQ ID NO: 30 can be employed in the compositions and fusion proteins of the invention. Exemplary R3D0 constructs include SEQ ID NOs: 30, 814, 815 and 816.

In yet another embodiment, the invention is a fusion protein comprising at least one amino acid sequence as set forth in SEQ ID NO: 30 (RO3 construct) and at least a portion of at least two antigens, wherein at least one antigen is between amino acid residues 145 and 146 of SEQ ID NO: 30 and at least one other antigen is fused to amino acid residue 318 of SEQ ID NO: 30, wherein the fusion protein activates a Toll-like Receptor 5.

Figure 59:
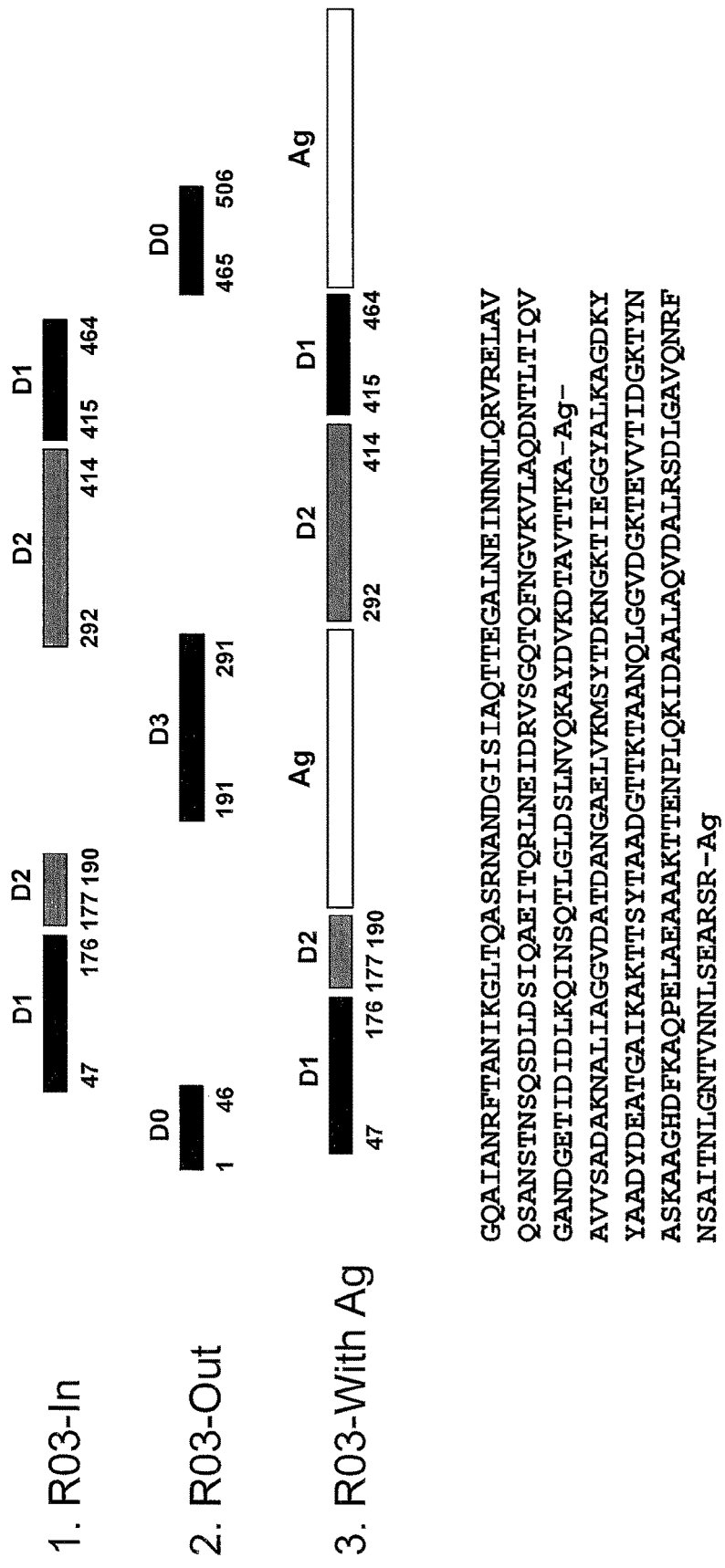
FIG. 59 depicts the domains (D0, D1, D2, D3) of a flagellin construct (SEQ ID NO: 30) and a fusion protein that includes, in sequence, the amino-domain 1, the amino-domain 2, the carboxy-domain 2 and the carboxy-domain 1. Two antigens (Ag) are in the fusion protein depicted in SEQ ID NO: 30. An antigen is fused between the amino-domain 2 and the carboxy-domain 2 of the flagellin construct and another antigen is fused to the carboxy-domain 1 of the flagellin construct. The flagellin construct is referred to herein as "the R03 construct."

FIG. 59 depicts the domains (D0, D1, D2, D3) of a flagellin construct (SEQ ID NO: 30) and a fusion protein that includes, in sequence, the amino-domain 1, the amino-domain 2, the carboxy-domain 2 and the carboxy-domain 1 of flagellin. At least a portion of one antigen is fused between the amino- and the carboxy-domain 2 of the flagellin construct and at least a portion of one other antigen is fused to the carboxy-domain 1 of the flagellin construct. The flagellin construct depicted in FIG. 59 lacks the D3 and D0 domains of flagellin and is referred to herein as an "R03 construct" or the "R03 form of flagellin" or "the R03 flagellin construct." "R03 construct," as used herein, means that Domain 3 of the flagellin is Replaced with an antigen and the carboxy-terminal Domain 0 is Replaced with a second similar or distinct antigen.

Exemplary R0 flagellin constructs fused to an HA influenza antigen (HA1-2(SI) (SEQ ID NO: 499) are shown below. The HA antigen sequence is underlined.

```
STF2fliCRO.HA1-2 (SI)                    (SEQ ID NO: 515)
MGQAIANRFTANIKGLTQASRNANDGISIAQTTEGALNEINNNLQRVRELAVQSANST
NSQSDLDSIQAEITQRLNEIDRVSGQTQFNGVKVLAQDNTLTIQVGANDGETIDIDLK
QINSQTLGLDTLNVQQKYKVSDTAATVTGYADTTIALDNSTFKASATGLGGTDQKIDG
DLKFDDTTGKYYAKVTVTGGTGKDGYYEVSVDKTNGEVTLAGGATSPLTGGLPATATE
DVKNVQVANADLTEAKAALTAAGVTGTASVVKMSYTDNNGKTIDGGLAVKVGDDYYSA
TQNKDGSISINTTKYTADDGTSKTALNKLGGADGKTEVVSIGGKTYAASKAEGHNFKA
QPDLAEAAATTTENPLQKIDAALAQVDTLRSDLGAVQNRFNSAITNLGNTVNNLTSAR
SRKGIAPLQLGNCSVAGWILGNPECELLISRESWSYIVEKPNPENGTCYPGHFADYEE
LREQLSSVSSFERFEIFPKESSWPNHTTTGVSASCSHNGESSFYKNLLWLTGKNGLYP
NLSKSYANNKEKEVLVLWGVHHPPNIGDQRALYHKENAYVSVVSSHYSRKFTPEIAKR
PKVRDQEGRINYYWTLLEPGDTIIFEANGNLIAPRYAFALSRGFGSGIINS STF2fliBRO.HA1-2 (SI)                    (SEQ ID NO: 516)
MGQAIANRFTANIKGLTQASRNANDGISIAQTTEGALNEINNNLQRVRELAVQSANST
NSQSDLDSIQAEITQRLNEIDRVSGQTQFNGVKVLAQDNTLTIQVGANDGETIDIDLK
QINSQTLGLDSLNVQKAYDVKDTAVTTKAYANNGTTLDVSGLDDAAIKAATGGTNGTA
SVTGGAVKFDADNNKYFVTIGGFTGADAAKNGDYEVNVATDGTVTLAAGATKTTMPAG
ATTKTEVQELKDTPAVVSADAKNALIAGGVDATDANGAELVKMSYTDKNGKTIEGGYA
LKAGDKYYAADYDEATGAIKAKTTSYTAADGTTKTAANQLGGVDGKTEVVTIDGKTYN
ASKAAGHDFKAQPELAEAAAKTTENPLQKIDAALAQVDALRSDLGAVQNRFNSAITNL
GNTVNNLSEARSRKGIAPLQLGNCSVAGWILGNPECELLISRESWSYIVEKPNPENGT
CYPGHFADYEELREQLSSVSSFERFEIFPKESSWPNHTTTGVSASCSHNGESSFYKNL
LWLTGKNGLYPNLSKSYANNKEKEVLVLWGVHHPPNIGDQRALYHKENAYVSVVSSHY
SRKFTPEIAKRPKVRDQEGRINYYWTLLEPGDTIIFEANGNLIAPRYAFALSRGFGSG
IINS
```

E.coliR0.HA1-2 (SI)                    (SEQ ID NO: 517)
MGQAIANRFTSNIKGLTQAARNANDGISVAQTTEGALSEINNNLQRIRELTVQASTGT
NSDSDLDSIQDEIKSRLDEIDRVSGQTQFNGVNVLAKDGSMKIQVGANDGQTITIDLK
KIDSDTLGLNGFNVNGSGTIANKAATISDLTAAKMDAATNTITTTNNALTASKALDQL
KDGDTVTIKADAAQTATVYTYNASAGNFSFSNVSNNTSAKAGDVAASLLPPAGQTASG
VYKAASGEVNFDVDANGKITIGGQEAYLTSDGNLTTNDAGGATAATLDGLFKKAGDGQ
SIGFNKTASVTMGGTTYNFKTGADAGAATANAGVSFTDTASKETVLNKVATAKQGTAV
AANGDTSATITYKSGVQTYQAVFAAGDGTASAKYADNTDVSNATATYTDADGEMTTIG
SYTTKYSIDANNGKVTVDSGTGTGKYAPKVGAEVYVSANGTLTTDATSEGTVTKDPLK
ALDEAISSIDKFRSSLGAIQNRLDSAVTNLNNTTTNLSEAQSRKGIAPLQLGNCSVAG
WILGNPECELLISRESWSYIVEKPNPENGTCYPGHFADYEELREQLSSVSSFERFEIF
PKESSWPNHTTTGVSASCSHNGESSFYKNLLWLTGKNGLYPNLSKSYANNKEKEVLVL
WGVHHPPNIGDQRALYHKENAYVSVVSSHYSRKFTPEIAKRPKVRDQEGRINYYWTLL
EPGDTIIFEANGNLIAPRYAFALSRGFGSGIINS Bacillus subtilisR0.HA1-2 (SI)         (SEQ ID NO: 518)
MGLAISEKMRSQIRGLDMASKNAQDGISLIQTSEGALNETHSILQRMSELATQAANDT
NTDSDRSELQKEMDQLASEVTRISTDTEFNTKKLLDGTAQNLTFQIGANEGQTMSLSI
NKMDSESLKVGTTYTVSGDQNTLTATDGSTATWADADDATNKPAGYYDAGGKVIASEK
LAADSKVTKGIDISSSAKAASSALTTIKTAIDTVSSERAKLGAVQNRLEHTINNLGTS
SENLTSAESRKGIAPLQLGNCSVAGWILGNPECELLISRESWSYIVEKPNPENGTCYP
GHFADYEELREQLSSVSSFERFEIFPKESSWPNHTTTGVSASCSHNGESSFYKNLLWL
TGKNGLYPNLSKSYANNKEKEVLVLWGVHHPPNIGDQRALYHKENAYVSVVSSHYSRK
FTPEIAKRPKVRDQEGRINYYWTLLEPGDTIIFEANGNLIAPRYAFALSRGFGSGIIN
S

```
                          10         20         30         40         50
                          |          |          |          |          |
fliCR0HA1_2SI    MGQAIANRFTANIKGLTQASRNANDGISIAQTTEGALNEINNNLQRVREL
fljBR0HA1_2      MGQAIANRFTANIKGLTQASRNANDGISIAQTTEGALNEINNNLQRVREL
BsubR0HA1_2      MGLAISEKMRSQIRGLDMASKNAQDGISLIQTSEGALNETHSILQRMSEL
EcoliR0HA1_2     MGQAIANRFTSNIKGLTQAARNANDGISVAQTTEGALSEINNNLQRIREL
                 ** **:.:: :.*:**   *::**:****: **:****.*  :. ***. **

60         70         80         90        100
                          |          |          |          |          |
fliCR0HA1_2SI    AVQSANSTNSQSDLDSIQAEITQRLNEIDRVSGQTQFNGVKVLA-QDNTL
fljBR0HA1_2      AVQSANSTNSQSDLDSIQAEITQRLNEIDRVSGQTQFNGVKVLA-QDNTL
BsubR0HA1_2      ATQAANDTNTDSDRSELQKEMDQLASEVTRISTDTEFNTKKLLDGTAQNL
EcoliR0HA1_2     TVQASTGTNSDSDLDSIQDEIKSRLDEIDRVSGQTQFNGVNVLA-KDGSM
                 :.*::.**::**  ...:* *:.  .*: *:* :*:**  ::*    .:

110        120        130        140        150
                          |          |          |          |          |
fliCR0HA1_2SI    TIQVGANDGETIDIDLKQINSQTLGLDTLNVQQKYKVSDTAATVTGYADT
fljBR0HA1_2      TIQVGANDGETIDIDLKQINSQTLGLDSLNVQKAYDVKDTAVTTKAYANN
BsubR0HA1_2      TFQIGANEGQTMSLSINKMDSE-----SLKVGTTYTVSG-----------
EcoliR0HA1_2     KIQVGANDGQTITIDLKKIDSDTLGLNGFNVNGSGTIANKAATISDLTAA
                 .:*:****:*:*:  .:.:::::*:         ::*        :  :

160        170        180        190        200
                          |          |          |          |          |
fliCR0HA1_2SI    -----TIAL-------------------DNSTFKASATGLGGTDQK--ID
fljBR0HA1_2      GTTLDVSGL-------------------DDAAIKAATGGTNGTASV--TG
BsubR0HA1_2      ----------------------------DQNTLTAT------------TG
EcoliR0HA1_2     KMDAATNTITTTNNALTASKALDQLKDGDTVTIKADAAQTATVYTYNASA
                                             *   ::.*

210        220        230        240        250
                          |          |          |          |          |
fliCR0HA1_2SI    GDLKFDDTTGKYYAKV------------T-VTGG-TGKDGYYEVSVDK--
fljBR0HA1_2      GAVKFDADNNKYFVTI------------GGFTGADAAKNGDYEVNVA---
BsubR0HA1_2      G-------------------------------------------------
EcoliR0HA1_2     GNFSFSNVSNNTSAKAGDVAASLLPPAGQTASGVYKAASGEVNFDVDANG
                 *

260        270        280        290        300
                          |          |          |          |          |
fliCR0HA1_2SI    ------------TNG--EVTLAGGATSPLTGGLPATATEDVKN--VQVAN
fljBR0HA1_2      ------------TDG--TVTLAAGATKTTMPAGATTKTEVQEL--KDTPA
BsubR0HA1_2      -------------S---TATWADADDATNKPAG-----------------
EcoliR0HA1_2     KITIGGQEAYLTSDGNLTTNDAGGATAATLDGLFKKAGDGQSIGFNKTAS
                            ..  *  .    .

310        320        330        340        350
                          |          |          |          |          |
fliCR0HA1_2SI    ADL----------TEAKAALTAAGVTGTAS----VVK-MSYTDNNGKTID
fljBR0HA1_2      VVS----------ADAKNALIAGGVDATDANGAELVK-MSYTDKNGKTIE
BsubR0HA1_2      ---------------------------------------YYDAGGKVIA
EcoliR0HA1_2     VTMGGTTYNFKTGADAGAATANAGVSFTDTASKETVLNKVATAKQGTAVA
                                                         *..:

360        370        380        390        400
                          |          |          |          |          |
fliCR0HA1_2SI    GG------LAVKVGDDYYSATQNKD-GSISINTTKYTADD---GTSKTAL
fljBR0HA1_2      GG------YALKAGDKYYAADYDEATGAIKAKTTSYTAAD---GTTKTAA
BsubR0HA1_2      S---------------------------------------EKLAAD
EcoliR0HA1_2     ANGDTSATITYKSGVQTYQAVFAAGDGTASAKYADNTDVSNATATYTDAD
                 *                                             *
```

-continued

```
                    410        420        430        440        450
                     |          |          |          |          |
fliCR0HA1_2SI   NKLGGADGKTEVVSIGGKTYAASKAEGHNF----------------KAQP
fljBR0HA1_2     NQLGGVDGKTEVVTIDGKTYNASKAAGHDF----------------KAQP
BsubR0HA1_2     SKV------TKGIDIS----------------------------------
EcoliR0HA1_2    GEMTTIGSYTTKYSIDANNGKVTVDSGTGTGKYAPKVGAEVYVSANGTLT
                .::         *       *.

460        470        480        490        500
                     |          |          |          |          |
fliCR0HA1_2SI   DLAEAAATTTENPLQKIDAALAQVDTLRSDLGAVQNRFNSAITNLGNTVN
fljBR0HA1_2     ELAEAAAKTTENPLQKIDAALAQVDALRSDLGAVQNRFNSAITNLGNTVN
BsubR0HA1_2     -SSAKAASS---ALTTIKTAIDTVSSERAKLGAVQNRLEHTINNLGTSSE
EcoliR0HA1_2    TDATSEGTVTKDPLKALDEAISSIDKFRSSLGAIQNRLDSAVTNLNNTTT
                 :   ..    .*   :.  *:   :.   *:.***:***::  ::.**..:

510        520        530        540        550
                     |          |          |          |          |
fliCR0HA1_2SI   NLTSARSRKGIAPLQLGNCSVAGWILGNPECELLISRESWSYIVEKPNPE
fljBR0HA1_2     NLSEARSRKGIAPLQLGNCSVAGWILGNPECELLISRESWSYIVEKPNPE
BsubR0HA1_2     NLTSAESRKGIAPLQLGNCSVAGWILGNPECELLISRESWSYIVEKPNPE
EcoliR0HA1_2    NLSEAQSRKGIAPLQLGNCSVAGWILGNPECELLISRESWSYIVEKPNPE
                **:.*.********************************************

560        570        580        590        600
                     |          |          |          |          |
fliCR0HA1_2SI   NGTCYPGHFADYEELREQLSSVSSFERFEIFPKESSWPNHTTTGVSASCS
fljBR0HA1_2     NGTCYPGHFADYEELREQLSSVSSFERFEIFPKESSWPNHTTTGVSASCS
BsubR0HA1_2     NGTCYPGHFADYEELREQLSSVSSFERFEIFPKESSWPNHTTTGVSASCS
EcoliR0HA1_2    NGTCYPGHFADYEELREQLSSVSSFERFEIFPKESSWPNHTTTGVSASCS
                **************************************************

610        620        630        640        650
                     |          |          |          |          |
fliCR0HA1_2SI   HNGESSFYKNLLWLTGKNGLYPNLSKSYANNKEKEVLVLWGVHHPPNIGD
fljBR0HA1_2     HNGESSFYKNLLWLTGKNGLYPNLSKSYANNKEKEVLVLWGVHHPPNIGD
BsubR0HA1_2     HNGESSFYKNLLWLTGKNGLYPNLSKSYANNKEKEVLVLWGVHHPPNIGD
EcoliR0HA1_2    HNGESSFYKNLLWLTGKNGLYPNLSKSYANNKEKEVLVLWGVHHPPNIGD
                **************************************************

660        670        680        690        700
                     |          |          |          |          |
fliCR0HA1_2SI   QRALYHKENAYVSVVSSHYSRKFTPEIAKRPKVRDQEGRINYYWTLLEPG
fljBR0HA1_2     QRALYHKENAYVSVVSSHYSRKFTPEIAKRPKVRDQEGRINYYWTLLEPG
BsubR0HA1_2     QRALYHKENAYVSVVSSHYSRKFTPEIAKRPKVRDQEGRINYYWTLLEPG
EcoliR0HA1_2    QRALYHKENAYVSVVSSHYSRKFTPEIAKRPKVRDQEGRINYYWTLLEPG
                **************************************************

710        720        730
                     |          |          |
fliCR0HA1_2SI   DTIIFEANGNLIAPRYAFALSRGFGSGIINS (SEQ ID NO: 515)
fljBR0HA1_2     DTIIFEANGNLIAPRYAFALSRGFGSGIINS (SEQ ID NO: 516)
BsubR0HA1_2     DTIIFEANGNLIAPRYAFALSRGFGSGIINS (SEQ ID NO: 517)
EcoliR0HA1_2    DTIIFEANGNLIAPRYAFALSRGFGSGIINS (SEQ ID NO: 518)
                *******************************
```

Alignment data:
Alignment length: 731
Identity (*): 295 is 40.36%
Strongly similar (:): 60 is 8.21%
Weakly similar (.): 36 is 4.92%
Different: 340 is 46.51%
Sequence 0001: fliCR0HA1_2SI (631 residues).
Sequence 0002: fljBR0HA1_2 (642 residues).
Sequence 0003: BsubR0HA1_2 (465 residues).
Sequence 0004: EcoliR0HA1_2 (730 residues).

When more than one antigen is employed in the compositions and fusion proteins of the invention, the antigens can be distinct antigens or similar antigens. "Distinct," as used herein in reference to antigens, means that the antigens are different types of antigens. Distinct antigens, for example, can be antigens of different regions of a virus or different viruses. For example, a hemagglutinin influenza viral protein antigen (e.g., SEQ ID NO: 499) and a matrix 2 influenza viral protein antigen (e.g., SEQ ID NO: 485) are distinct antigens for use in the fusion proteins of the invention. Likewise, an influenza A antigen and an influenza B antigen are distinct antigens. "Similar," as used herein in reference to antigens, means that the antigens are antigens of a common type. For example, a hemagglutinin influenza viral protein antigen of SEQ ID NO: 481 and a hemagglutinin influenza viral protein antigen of SEQ ID NO: 499 are similar antigens for use in the fusion proteins of the invention. Similar antigens employed in the fusion proteins of the invention can also be antigens of the same or identical amino acid sequence.

In yet another embodiment, the invention is a fusion protein comprising at least one amino acid sequence as set forth in SEQ ID NO: 29 (R3-2xAg construct) and at least a portion of at least two antigens, wherein at least one antigen is between amino acid residues 190 and 191 of SEQ ID NO: 29 and at least one other antigen is fused to amino acid residue 405 of SEQ ID NO: 29, and wherein the fusion protein activates a Toll-like Receptor 5.

FIG. 60 depicts the domains (D0, D1, D2, D3) of a flagellin construct (SEQ ID NO: 29) and a fusion protein that includes, in sequence, the amino-domain 0, the amino-domain 1, the amino-domain 2, the carboxy-domain 2, the carboxy-domain 1 and the carboxy-domain 0 of flagellin. The fusion protein depicted in SEQ ID NO: 29 has at least a portion of at least one antigen and at least a portion of at least one other antigen. One antigen is fused between the amino-domain 2 and the carboxy-domain 2 of the flagellin construct. The other antigen is fused to the carboxy-terminal amino acid of the domain 0 of the flagellin construct. The flagellin construct depicted in FIG. 60 lacks the D3 domain of flagellin and is referred to herein as an "R3-2xAg construct" or the "R3-2xAg form of flagellin" or "R32x flagellin construct" or "R32x" or the "R32x form of flagellin" or "2xR3" or the "2xR3 form of flagellin" or the "R3/2x form of flagellin." "R3-2xAg construct," as used herein, means that Domain 3 of the flagellin is Replaced with a one antigen and another antigen is fused to the carboxy-terminus of Domain 0. For example, one antigen can be fused between amino acids 190 and 191 of SEQ ID NO: 29 and another antigen can be fused to the terminal carboxy amino acid (e.g., SEQ ID NO: 504, 505).

Exemplary R32x flagellin constructs fused to an influenza antigen (HA1-2 (SI) (SEQ ID NO: 499)) are depicted below. The HA antigen sequence is underlined.

```
STF2fliC.R32xHA1-2(SI)                     (SEQ ID NO: 503)
MAQVINTNSLSLLTQNNLNKSQSALGTAIERLSSGLRINSAKDDAAGQAIANRFTANI
KGLTQASRNANDGISIAQTTEGALNEINNNLQRVRELAVQSANSTNSQSDLDSIQAEI
TQRLNEIDRVSGQTQFNGVKVLAQDNTLTIQVGANDGETIDIDLKQINSQTLGLDTLN
VQQKYKVSDTAATVTGKGIAPLQLGNCSVAGWILGNPECELLISRESWSYIVEKPNPE
NGTCYPGHFADYEELREQLSSVSSFERFEIFPKESSWPNHTTTGVSASCSHNGESSFY
KNLLWLTGKNGLYPNLSKSYANNKEKEVLVLWGVHHPPNIGDQRALYHKENAYVSVVS
SHYSRKFTPEIAKRPKVRDQEGRINYYWTLLEPGDTIIFEANGNLIAPRYAFALSRGF
GSGIINSNADLTEAKAALTAAGVTGTASVVKMSYTDNNGKTIDGGLAVKVGDDYYSAT
QNKDGSISINTTKYTADDGTSKTALNKLGGADGKTEVVSIGGKTYAASKAEGHNFKAQ
PDLAEAAATTTENPLQKIDAALAQVDTLRSDLGAVQNRFNSAITNLGNTVNNLTSARS
RIEDSDYATEVSNMSRAQILQQAGTSVLAQANQVPQNVLSLLAKGIAPLQLGNCSVAG
WILGNPECELLISRESWSYIVEKPNPENGTCYPGHFADYEELREQLSSVSSFERFEIF
PKESSWPNHTTTGVSASCSHNGESSFYKNLLWLTGKNGLYPNLSKSYANNKEKEVLVL
WGVHHPPNIGDQRALYHKENAYVSVVSSHYSRKFTPEIAKRPKVRDQEGRINYYWTLL
EPGDTIIFEANGNLIAPRYAFALSRGFGSGIINS STF2fljBR32xHA1-2(SI)                      (SEQ ID NO: 504)
MAQVINTNSLSLLTQNNLNKSQSALGTAIERLSSGLRINSAKDDAAGQAIANRFTANI
KGLTQASRNANDGISIAQTTEGALNEINNNLQRVRELAVQSANSTNSQSDLDSIQAEI
TQRLNEIDRVSGQTQFNGVKVLAQDNTLTIQVGANDGETIDIDLKQINSQTLGLDSLN
VQKAYDVKDTAVTTKAKGIAPLQLGNCSVAGWILGNPECELLISRESWSYIVEKPNPE
NGTCYPGHFADYEELREQLSSVSSFERFEIFPKESSWPNHTTTGVSASCSHNGESSFY
KNLLWLTGKNGLYPNLSKSYANNKEKEVLVLWGVHHPPNIGDQRALYHKENAYVSVVS
SHYSRKFTPEIAKRPKVRDQEGRINYYWTLLEPGDTIIFEANGNLIAPRYAFALSRGF
GSGIINSAVVSADAKNALIAGGVDATDANGAELVKMSYTDKNGKTIEGGYALKAGDKY
YAADYDEATGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITNLGNTVNNL
SEARSRIEDSDYATEVSNMSRAQILQQAGTSVLAQANQVPQNVLSLLAKGIAPLQLGN
CSVAGWILGNPECELLISRESWSYIVEKPNPENGTCYPGHFADYEELREQLSSVSSFE
RFEIFPKESSWPNHTTTGVSASCSHNGESSFYKNLLWLTGKNGLYPNLSKSYANNKEK
EVLVLWGVHHPPNIGDQRALYHKENAYVSVVSSHYSRKFTPEIAKRPKVRDQEGRINY
YWTLLEPGDTIIFEANGNLIAPRYAFALSRGFGSGIINS E.coliR32xHA1-2(SI)                        (SEQ ID NO: 505)
MAQVINTNSLSLITQNNINKNQSALSSSIERLSSGLRINSAKDDAAGQAIANRFTSNI
KGLTQAARNANDGISVAQTTEGALSEINNNLQRIRELTVQASTGTNSDSDLDSIQDEI
KSRLDEIDRVSGQTQFNGVNVLAKDGSMKIQVGANDGQTITIDLKKIDSDTLGLNGFN
VNGSGTIANKAATISDKGIAPLQLGNCSVAGWILGNPECELLISRESWSYIVEKPNPE
NGTCYPGHFADYEELREQLSSVSSFERFEIFPKESSWPNHTTTGVSASCSHNGESSFY
KNLLWLTGKNGLYPNLSKSYANNKEKEVLVLWGVHHPPNIGDQRALYHKENAYVSVVS
SHYSRKFTPEIAKRPKVRDQEGRINYYWTLLEPGDTIIFEANGNLIAPRYAFALSRGF
GSGIINSSVTMGGTTYNFKTGADAGAATANAGVSFTDTASKETVLNKVATAKQGTAVA
ANGDTSATITYKSGVQTYQAVFAAGDGTASAKYADNTDVSNATATYTDADGEMTTIGS
YTTKYSIDANNGKVTVDSGTGTGKYAPKVGAEVYVSANGTLTTDATSEGTVTKDPLKA
LDEAISSIDKFRSSLGAIQNRLDSAVTNLNNTTTNLSEAQSRIQDADYATEVSNMSKA
QIIQQAGNSVLAKANQVPQQVLSLLQGKGIAPLQLGNCSVAGWILGNPECELLISRES
WSYIVEKPNPENGTCYPGHFADYEELREQLSSVSSFERFEIFPKESSWPNHTTTGVSA
SCSHNGESSFYKNLLWLTGKNGLYPNLSKSYANNKEKEVLVLWGVHHPPNIGDQRALY
HKENAYVSVVSSHYSRKFTPEIAKRPKVRDQEGRINYYWTLLEPGDTIIFEANGNLIA
PRYAFALSRGFGSGIINS Bacillus subtilisR32xHA1-2 (SI)            (SEQ ID NO: 506)
MRINHNIAALNTSRQLNAGSDSAAKNMEKLSSGLRINRAGDDAAGLAISEKMRSQIRG
LDMASKNAQDGISLIQTSEGALNETHSILQRMSELATQAANDTNTDSDRSELQKEMDQ
LASEVTRISTDTEFNTKKLLDGTAQNLTFQIGANEGQTMSLSINKMDSESLKVGTTYT
VSGKGIAPLQLGNCSVAGWILGNPECELLISRESWSYIVEKPNPENGTCYPGHFADYE
ELREQLSSVSSFERFEIFPKESSWPNHTTTGVSASCSHNGESSFYKNLLWLTGKNGLY
PNLSKSYANNKEKEVLVLWGVHHPPNIGDQRALYHKENAYVSVVSSHYSRKFTPEIAK
RPKVRDQEGRINYYWTLLEPGDTIIFEANGNLIAPRYAFALSRGFGSGIINSWADADD
ATNKPAGYYDAGGKVIASEKLAADSKVTKGIDISSSAKAASSALTTIKTAIDTVSSER
AKLGAVQNRLEHTINNLGTSSENLTSAESRIRDVDMASEMMEYTKNNILTQASQAMLA
QANQKGIAPLQLGNCSVAGWILGNPECELLISRESWSYIVEKPNPENGTCYPGHFADY
EELREQLSSVSSFERFEIFPKESSWPNHTTTGVSASCSHNGESSFYKNLLWLTGKNGL
YPNLSKSYANNKEKEVLVLWGVHHPPNIGDQRALYHKENAYVSVVSSHYSRKFTPEIA
KRPKVRDQEGRINYYWTLLEPGDTIIFEANGNLIAPRYAFALSRGFGSGIINS 10        20        30        40        50
                              |         |         |         |         |
fliCR32xHA1_2SI    MAQVINTNSLSLLTQNNLNKSQSALGTAIERLSSGLRINSAKDDAAGQAI
fljBR32xHA1_2SI    MAQVINTNSLSLLTQNNLNKSQSALGTAIERLSSGLRINSAKDDAAGQAI
EcoliR32xHA1_2SI   MAQVINTNSLSLITQNNINKNQSALSSSIERLSSGLRINSAKDDAAGQAI
BsubR32xHA1_2SI    --MRINHNIAALNTSRQLNAGSDSAAKNMEKLSSGLRINRAGDDAAGLAI
                     ** *   :* *..:* ...:  .. :*:******* *  ***** **
```

```
                        60         70         80         90        100
                         |          |          |          |          |
fliCR32xHA1_2SI  ANRFTANIKGLTQASRNANDGISIAQTTEGALNEINNNLQRVRELAVQSA
fljBR32xHA1_2SI  ANRFTANIKGLTQASRNANDGISIAQTTEGALNEINNNLQRVRELAVQSA
EcoliR32xHA1_2SI ANRFTSNIKGLTQAARNANDGISVAQTTEGALSEINNNLQRIRELTVQAS
BsubR32xHA1_2SI  SEKMRSQIRGLDMASKNAQDGISLIQTSEGALNETHSILQRMSELATQAA
                 : :: : ::*:**  *::**:****: **:****.* :. ***: **:.*::

110        120        130        140        150
                         |          |          |          |          |
fliCR32xHA1_2SI  NSTNSQSDLDSIQAEITQRLNEIDRVSGQTQFNGVKVLAQDNT-LTIQVG
fljBR32xHA1_2SI  NSTNSQSDLDSIQAEITQRLNEIDRVSGQTQFNGVKVLAQDNT-LTIQVG
EcoliR32xHA1_2SI TGTNSDSDLDSIQDEIKSRLDEIDRVSGQTQFNGVNVLAKDGS-MKIQVG
BsubR32xHA1_2SI  NDTNTDSDRSELQKEMDQLASEVTRISDTEFNTKKLLDGTAQNLTFQIG
                 ..**::** ..:* *:. . .*: *:* *:** ::*     :.:*:*

160        170        180        190        200
                         |          |          |          |          |
fliCR32xHA1_2SI  ANDGETIDIDLKQINSQTLGLDTLNVQQKYKVSDTAATVTGKGIAPLQLG
fljBR32xHA1_2SI  ANDGETIDIDLKQINSQTLGLDSLNVQKAYDVKDTAVTTKAKGIAPLQLG
EcoliR32xHA1_2SI ANDGQTITIDLKKIDSDTLGLNGFNVNGSGTIANKAATISDKGIAPLQLG
BsubR32xHA1_2SI  ANEGQTMSLSINKMDSESLKVG------------TTYTVSGKGIAPLQLG
                 **:*:*: .:.:::::*::*  :.            .: * . *********

210        220        230        240        250
                         |          |          |          |          |
fliCR32xHA1_2SI  NCSVAGWILGNPECELLISRESWSYIVEKPNPENGTCYPGHFADYEELRE
fljBR32xHA1_2SI  NCSVAGWILGNPECELLISRESWSYIVEKPNPENGTCYPGHFADYEELRE
EcoliR32xHA1_2SI NCSVAGWILGNPECELLISRESWSYIVEKPNPENGTCYPGHFADYEELRE
BsubR32xHA1_2SI  NCSVAGWILGNPECELLISRESWSYIVEKPNPENGTCYPGHFADYEELRE
                 **************************************************

260        270        280        290        300
                         |          |          |          |          |
fliCR32xHA1_2SI  QLSSVSSFERFEIFPKESSWPNHTTTGVSASCSHNGESSFYKNLLWLTGK
fljBR32xHA1_2SI  QLSSVSSFERFEIFPKESSWPNHTTTGVSASCSHNGESSFYKNLLWLTGK
EcoliR32xHA1_2SI QLSSVSSFERFEIFPKESSWPNHTTTGVSASCSHNGESSFYKNLLWLTGK
BsubR32xHA1_2SI  QLSSVSSFERFEIFPKESSWPNHTTTGVSASCSHNGESSFYKNLLWLTGK
                 **************************************************

310        320        330        340        350
                         |          |          |          |          |
fliCR32xHA1_2SI  NGLYPNLSKSYANNKEKEVLVLWGVHHPPNIGDQRALYHKENAYVSVVSS
fljBR32xHA1_2SI  NGLYPNLSKSYANNKEKEVLVLWGVHHPPNIGDQRALYHKENAYVSVVSS
EcoliR32xHA1_2SI NGLYPNLSKSYANNKEKEVLVLWGVHHPPNIGDQRALYHKENAYVSVVSS
BsubR32xHA1_2SI  NGLYPNLSKSYANNKEKEVLVLWGVHHPPNIGDQRALYHKENAYVSVVSS
                 **************************************************

360        370        380        390        400
                         |          |          |          |          |
fliCR32xHA1_2SI  HYSRKFTPEIAKRPKVRDQEGRINYYWTLLEPGDTIIFEANGNLIAPRYA
fljBR32xHA1_2SI  HYSRKFTPEIAKRPKVRDQEGRINYYWTLLEPGDTIIFEANGNLIAPRYA
EcoliR32xHA1_2SI HYSRKFTPEIAKRPKVRDQEGRINYYWTLLEPGDTIIFEANGNLIAPRYA
BsubR32xHA1_2SI  HYSRKFTPEIAKRPKVRDQEGRINYYWTLLEPGDTIIFEANGNLIAPRYA
                 **************************************************

410        420        430        440        450
                         |          |          |          |          |
fliCR32xHA1_2SI  FALSRGFGSGIINSNADL----------TEAKAALTAAGVTGTAS-----
fljBR32xHA1_2SI  FALSRGFGSGIINSAVVS----------ADAKNALIAGGVDATDANGAE-
EcoliR32xHA1_2SI FALSRGFGSGIINSSVTMGGTTYNFKTGADAGAATANAGVSFTDTASKET
BsubR32xHA1_2SI  FALSRGFGSGIINSWADA--------------------------------
                 ************** .

460        470        480        490        500
                         |          |          |          |          |
fliCR32xHA1_2SI  VVKMSYTDNNGKTIDGG----------------LAVKVGDDYYSATQNK
fljBR32xHA1_2SI  LVKMSYTDKNGKTIEGG----------------YALKAGDKYYAADYDE
EcoliR32xHA1_2SI VLNKVATAKQGTAVAANGDTSATITYKSGVQTYQAVFAAGDGTASAKYAD
BsubR32xHA1_2SI  --------------------------------------------------

510        520        530        540        550
                         |          |          |          |          |
fliCR32xHA1_2SI  D-GSISINTTKYTADDGTSKTALN-----KLGGADGKTEVVSIGGKTYAA
fljBR32xHA1_2SI  ATGAIKAKTTSYTAADGTTKTAAN-----QLGGVDGKTEVVTIDGKTYNA
EcoliR32xHA1_2SI N-TDVSNATATYTDADGEMTTIGSYTTKYSIDANNGKVTVDSGTGTGKYA
BsubR32xHA1_2SI  --DDATNKPAGYYDAG---------------------------GKVIAS
                   . .: *  .                                 *.  :

560        570        580        590        600
                         |          |          |          |          |
fliCR32xHA1_2SI  SKAEGHNFKAQP----DLAEAAATTTENPLQKIDAALAQVDTLRSDLGAV
fljBR32xHA1_2SI  SKAAGHDFKAQP----ELAEAAAKTTENPLQKIDAALAQVDALRSDLGAV
EcoliR32xHA1_2SI PKVGAEVYVSANGTLTTDATSEGTVTKDPLKALDEAISSIDKFRSSLGAI
BsubR32xHA1_2SI  EKLAADSKVTKG----IDISSSAKAASSALTTIKTAIDTVSSERAKLGAV
                  *   ..   :       :. ......* :. *:   :.  *:.***:
```

```
                    610        620        630        640        650
                     |          |          |          |          |
fliCR32xHA1_2SI  QNRFNSAITNLGNTVNNLTSARSRIEDSDYATEVSNMSRAQILQQAGTSV
fljBR32xHA1_2SI  QNRFNSAITNLGNTVNNLSEARSRIEDSDYATEVSNMSRAQILQQAGTSV
EcoliR32xHA1_2SI QNRLDSAVTNLNNTTTNLSEAQSRIQDADYATEVSNMSKAQIIQQAGNSV
BsubR32xHA1_2SI  QNRLEHTINNLGTSSENLTSAESRIRDVDMASEMMEYTKNNILTQASQAM
                 ***:: ::.**..:  **:.*.***.* * *:*:  :  :: :*: **. ::

660        670        680        690        700
                     |          |          |          |          |
fliCR32xHA1_2SI  LAQANQVPQNVLSLLA-KGIAPLQLGVCSVAGWILGNPECELLISRESWS
fljBR32xHA1_2SI  LAQANQVPQNVLSLLA-KGIAPLQLGNCSVAGWILGNPECELLISRESWS
EcoliR32xHA1_2SI LAKANQVPQQVLSLLQGKGIAPLQLGNCSVAGWILGNPECELLISRESWS
BsubR32xHA1_2SI  LAQAN----Q-------KGIAPLQLGNCSVAGWILGNPECELLISRESWS
                 **:**    :        *********************************

710        720        730        740        750
                     |          |          |          |          |
fliCR32xHA1_2SI  YIVEKPNPENGTCYPGHFADYEELREQLSSVSSFERFEIFPKESSWPNHT
fljBR32xHA1_2SI  YIVEKPNPENGTCYPGHFADYEELREQLSSVSSFERFEIFPKESSWPNHT
EcoliR32xHA1_2SI YIVEKPNPENGTCYPGHFADYEELREQLSSVSSFERFEIFPKESSWPNHT
BsubR32xHA1_2SI  YIVEKPNPENGTCYPGHFADYEELREQLSSVSSFERFEIFPKESSWPNHT
                 **************************************************

760        770        780        790        800
                     |          |          |          |          |
fliCR32xHA1_2SI  TTGVSASCSHNGESSFYKNLLWLTGKNGLYPNLSKSYANNKEKEVLVLWG
fljBR32xHA1_2SI  TTGVSASCSHNGESSFYKNLLWLTGKNGLYPNLSKSYANNKEKEVLVLWG
EcoliR32xHA1_2SI TTGVSASCSHNGESSFYKNLLWLTGKNGLYPNLSKSYANNKEKEVLVLWG
BsubR32xHA1_2SI  TTGVSASCSHNGESSFYKNLLWLTGKNGLYPNLSKSYANNKEKEVLVLWG
                 **************************************************

810        820        830        840        850
                     |          |          |          |          |
fliCR32xHA1_2SI  VHHPPNIGDQRALYHKENAYVSVVSSHYDRKFTPEIAKRPKVRDQEGRIN
fljBR32xHA1_2SI  VHHPPNIGDQRALYHKENAYVSVVSSHYSRKFTPEIAKRPKVRDQEGRIN
EcoliR32xHA1_2SI VHHPPNIGDQRALYHKENAYVSVVSSHYSRKFTPEIAKRPKVRDQEGRIN
BsubR32xHA1_2SI  VHHPPNIGDQRALYHKENAYVSVVSSHYSRKFTPEIAKRPKVRDQEGRIN
                 ****************************.*********************

860        870        880        890
                     |          |          |          |
fliCR32xHA1_2SI  YYWTLLEPGDTIIFEANGNLIAPRYAFALSRGFGSGIINS  (SEQ ID NO: 503)
fljBR32xHA1_2SI  YYWTLLEPGDTIIFEANGNLIAPRYAFALSRGFGSGIINS  (SEQ ID NO: 504)
EcoliR32xHA1_2SI YYWTLLEPGDTIIFEANGNLIAPRYAFALSRGFGSGIINS  (SEQ ID NO: 505)
BsubR32xHA1_2SI  YYWTLLEPGDTIIFEANGNLIAPRYAFALSRGFGSGIINS  (SEQ ID NO: 506)
                 ****************************************
```

Alignment data:
Alignment length: 890
Identity (*): 545 is 61.24%
Strongly similar (:): 76 is 8.54%
Weakly similar (.): 44 is 4.94%
Different: 225 is 25.28%
Sequence 0001: fliCR32xHA1_2SI (846 residues).
Sequence 0002: fljBR32xHA1_2SI (851 residues).
Sequence 0003: EcoliR32xHA1_2SI (888 residues).
Seuqence 0004: BsubR32xHA1_2SI (749 residues).

An additional embodiment of the invention is a fusion protein comprising, in sequence, at least one amino acid sequence as set forth in SEQ ID NO: 31 (D3N construct) and at least a portion of at least one antigen, wherein the fusion protein activates a Toll-like Receptor 5.

Figure 61:
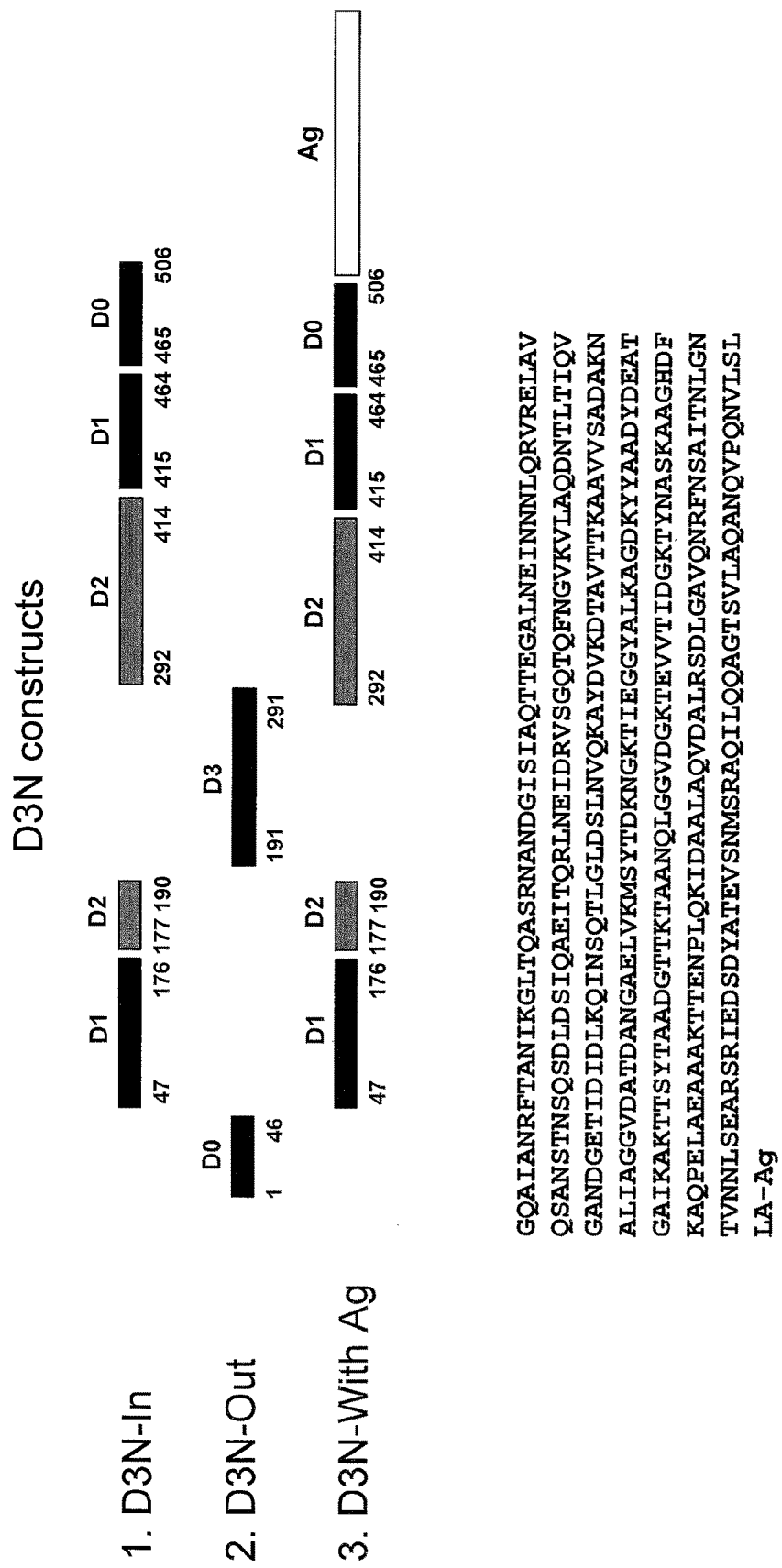
FIG. 61 depicts the domains (D0, D1, D2, D3) of a flagellin construct (SEQ ID NO: 31) and a fusion protein that includes, in sequence, the amino-domain 1, the amino-domain 2, the carboxy-domain 2, the carboxy-domain 1 and the carboxy-domain 0 of flagellin fused to an antigen (Ag). The flagellin construct is referred to herein as "the D3N construct."

FIG. 61 depicts the domains (D0, D1, D2, D3) of a flagellin construct (SEQ ID NO: 31) and a fusion protein that includes, in sequence, the amino-domain 1, the amino-domain 2, the carboxy-domain 2, the carboxy-domain 1 and the carboxy-domain 0 of flagellin fused to an antigen (Ag). The flagellin construct depicted in FIG. 61 lacks the D3 domain and amino-domain 0 of flagellin and is referred to herein as an "D3N construct" or the "D3N form of flagellin" or "D3N flagellin construct." "D3N construct," as used herein, means that the amino(N)-terminus of Domain 0 is lacking, the Domain 3 of the flagellin is lacking and the carboxy-terminus of Domain 0 is fused to an antigen described herein. An amino acid sequence that activates TLR5 and has at least about 50.0%, at least about 60.0%, at least about 80.0%, at least about 85.0%, at least about 90.0%, at least about 95.0%, at least about 98.0% and at least about 99.0% identity to a contiguous amino acid sequence, without any insertions or deletions, as set forth in SEQ ID NO: 31 can be employed in the compositions, fusion proteins and methods of the invention. Exemplary D3N constructs include SEQ ID NOs: 31, 817, 818 and 819.

A further embodiment of the invention is a fusion protein comprising, in sequence, at least one amino acid sequence as set forth in SEQ ID NO: 32 (an D3NCs construct) and at least a portion of at least one antigen, wherein the fusion protein activates a Toll-like Receptor 5.

Figure 62:
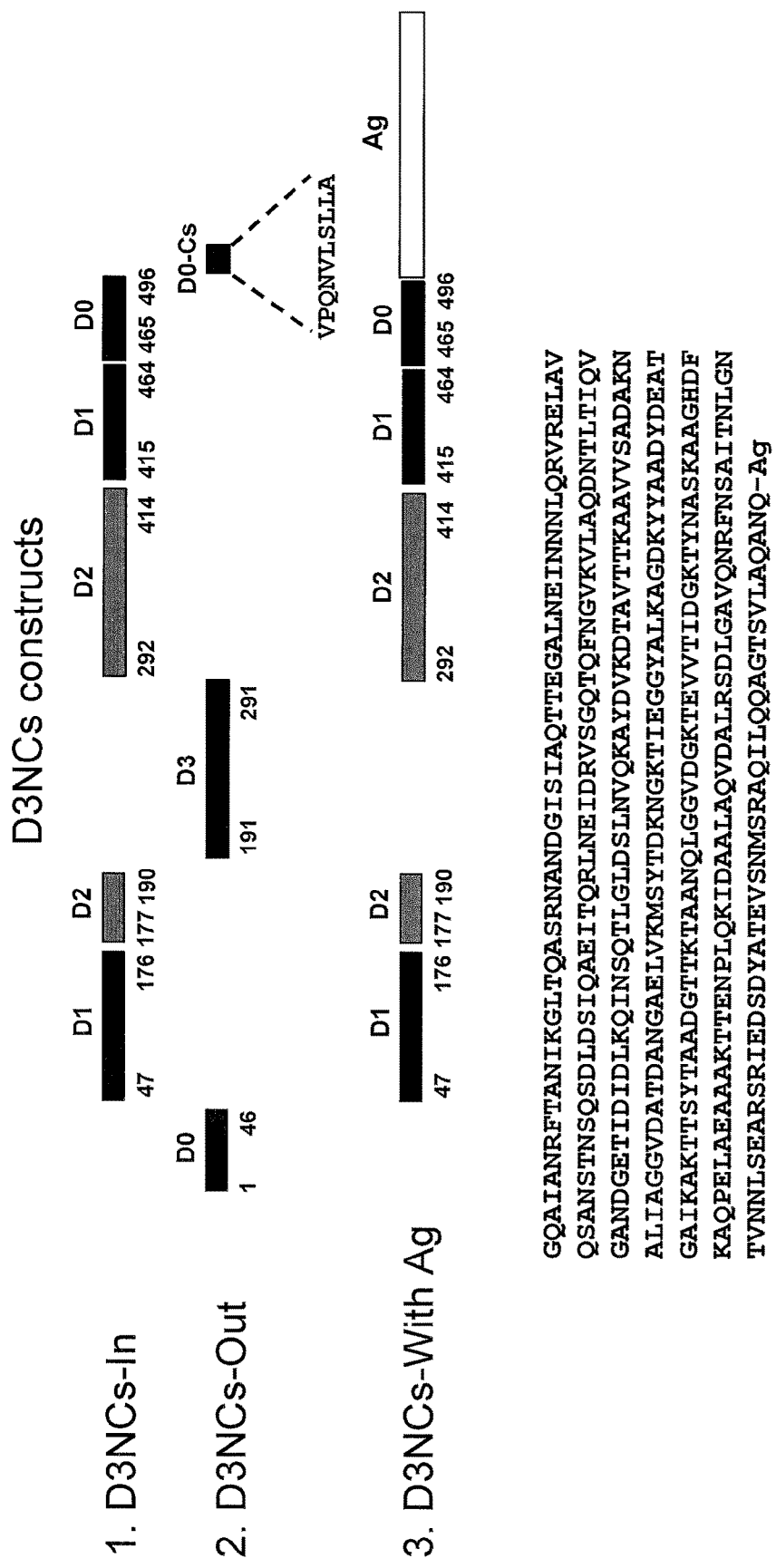
FIG. 62 depicts the domains (D0, D1, D2, D3) of a flagellin construct (SEQ ID NO: 32) and a fusion protein that includes, in sequence, the amino-domain 1, the amino-domain 2, the carboxy-domain 2, the carboxy-domain 1 of flagellin. The flagellin construct lacks a portion of a carboxy-domain 0, for example, the amino acid sequence VPQNVLSLLA (SEQ ID NO: 693). An antigen is fused to the carboxy-terminal amino acid of the flagellin construct. The flagellin construct is referred to herein as "the D3NCs construct."

FIG. 62 depicts the domains (D0, D1, D2, D3) of a flagellin construct (SEQ ID NO: 32) and a fusion protein that includes, in sequence, the amino-domain 1, the amino-domain 2, the carboxy-domain 2, the carboxy-domain 1, and at least a portion of the carboxy-domain 0 of flagellin. In a particular embodiment, the amino acid sequence VPQNVLSLLA (referred to as "D0-Cs"; SEQ ID NO: 693) is removed from the carboxy-domain 0 of flagellin and the resulting flagellin construct fused to an antigen (Ag). The flagellin construct depicted in FIG. 62 lacks the amino-domain 0, lacks domain 3 of flagellin and has a carboxy-domain 0 that lacks the carboxy-terminal amino acid sequence VPQNVLSLLA (SEQ ID NO:693) of flagellin to which an antigen is linked.

The resulting flagellin construct is referred to herein as an "D3NCs construct" or the "D3NCs form of flagellin" or "D3NCs flagellin construct." "D3NCs construct," as used herein, means that the amino(N)-terminus of Domain 0 is lacking, Domain 3 of the flagellin is lacking, the amino acid sequence of SEQ ID NO: 693 is lacking from the carboxy-domain 0 and the carboxy-terminus of the resulting portion of the flagellin is fused to an antigen. An amino acid sequence that activates a TLR5 and has at least about 60.0%, at least about 70.0%, at least about 80.0%, at least about 85.0%, at least about 90.0%, at least about 95.0%, at least about 98.0% and at least about 99.0% identity to a contiguous amino acid sequence, without any insertions or deletions, as set forth in SEQ ID NO: 32 can be employed in the compositions, fusion proteins and methods of the invention. Exemplary D3NCs constructs include SEQ ID NOs: 32, 820, 821 and 822.

Another embodiment of the invention is a fusion protein comprising, in sequence, at least one amino acid sequence as set forth in SEQ ID NO: 33 (D1 construct) and at least a portion of at least one antigen, wherein the fusion protein activates a Toll-like Receptor 5.

Figure 63:
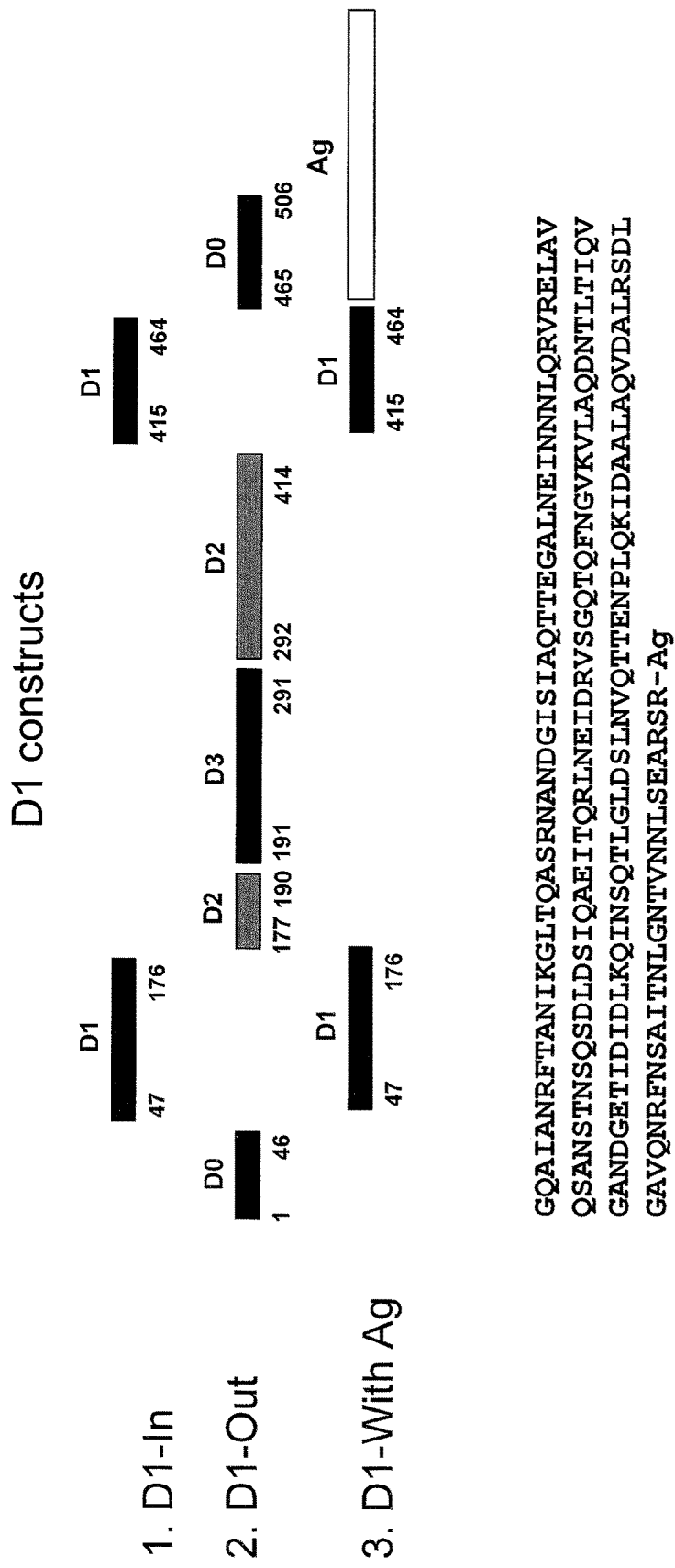
FIG. 63 depicts the domains (D0, D1, D2, D3) of flagellin construct (SEQ ID NO: 33) and a fusion protein that includes, in sequence, the amino-domain 1 and the carboxy-domain 1 of flagellin fused to an antigen (Ag). The antigen is fused to the carboxy-terminal amino acid of the carboxy-domain 1 of the flagellin construct. The flagellin construct is referred to herein as "the D0D2D3 construct" or "the D1 construct."
Figure 64:
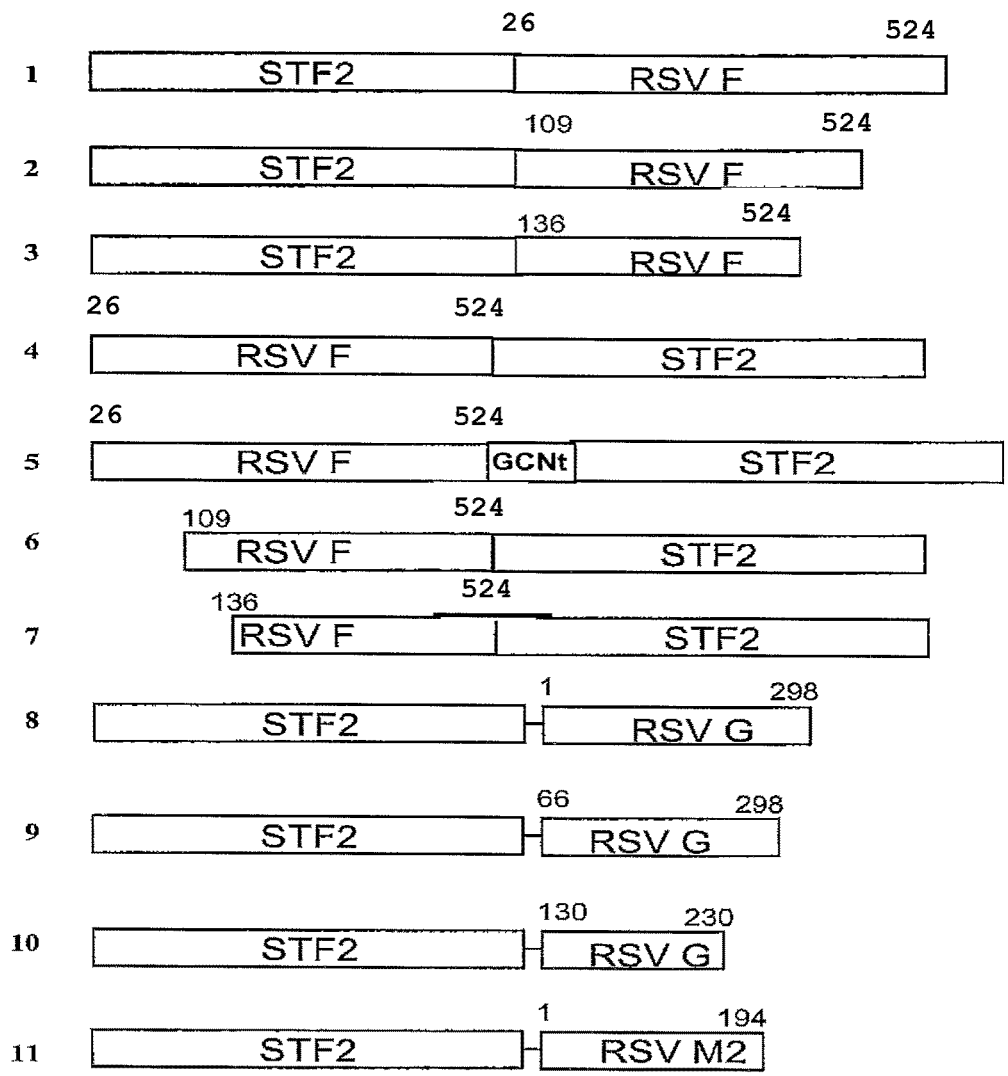
FIG. 64 depicts fusion proteins that include flagellin and portions of RSV F protein.
Figure 67:
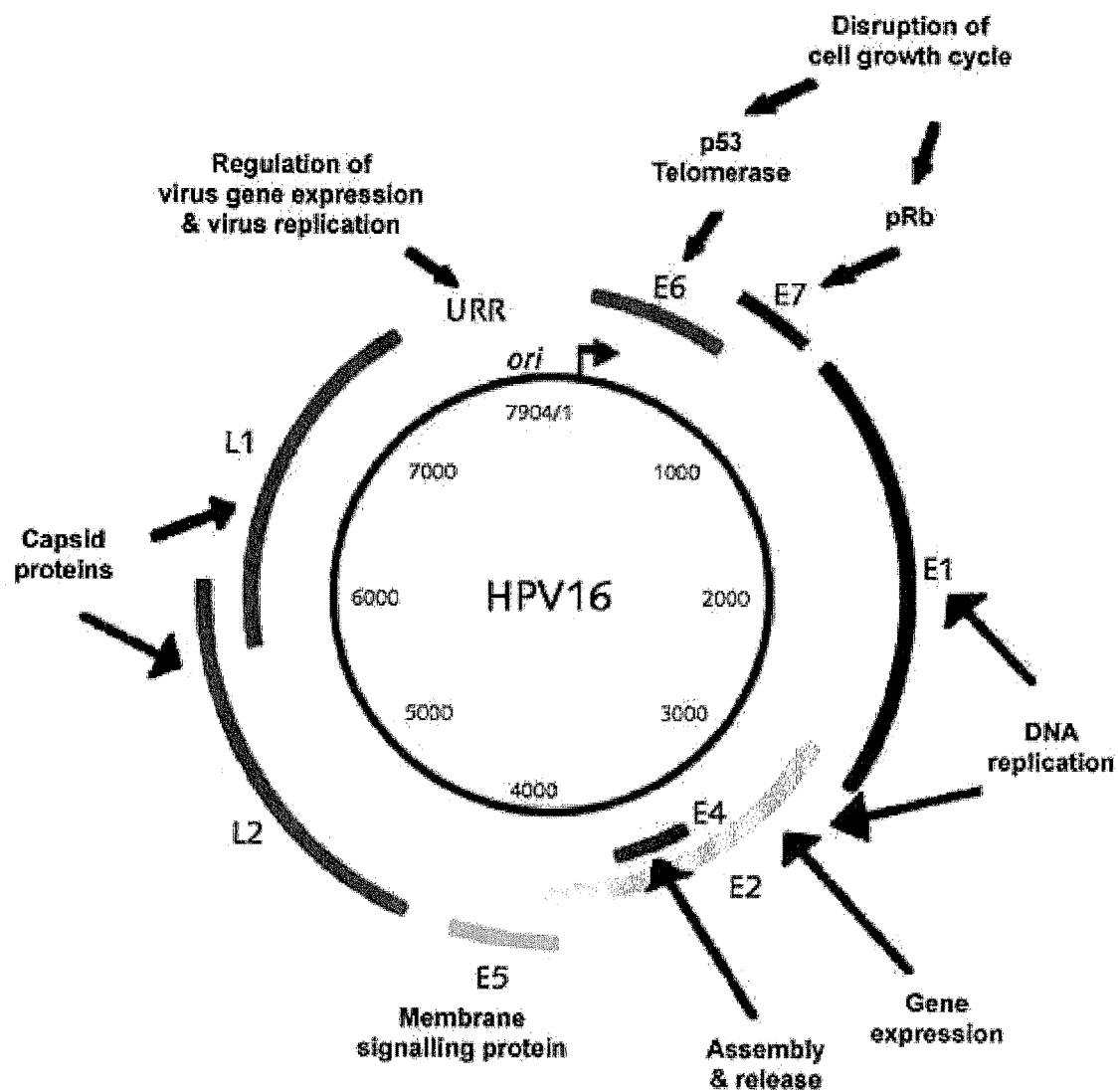
FIG. 67 depicts the HPV16 genome.
Figure 68:
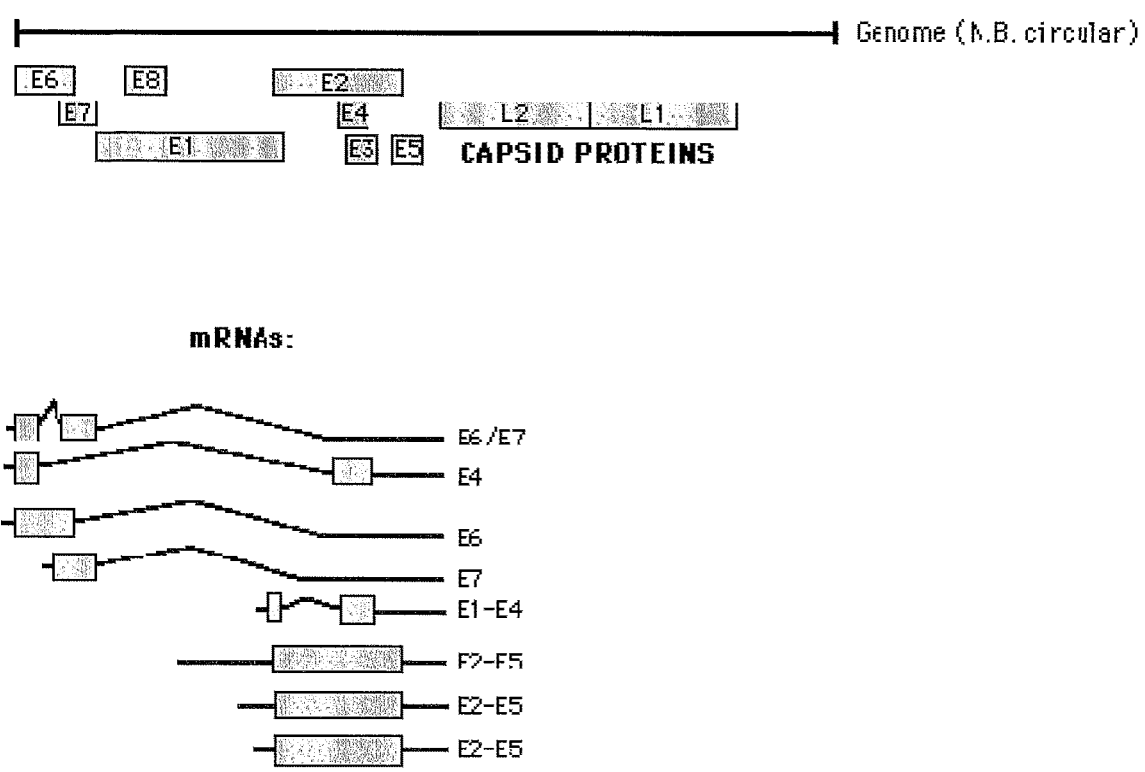
FIG. 68 depicts the HPV genome, mRNA and proteins.

FIG. 63 depicts the domains (D0, D1, D2, D3) of a flagellin construct (SEQ ID NO: 33) and a fusion protein that includes, in sequence, the amino-domain 1 and the carboxy-domain 1 of flagellin fused to an antigen (Ag). The antigen is fused to the carboxy-terminal amino acid of the carboxy-domain 1 of the flagellin construct. The flagellin construct depicted in FIG. 63 lacks all domains (D0, D2, D3) except the amino- and carboxy-domain 1 and is referred to herein as an "D1 construct" or the "D1 form of flagellin" or "D1 flagellin construct." "D1 construct," as used herein, means that the flagellin component consists of Domain 1 fused to an antigen described herein. An amino acid sequence that activates a TLR5 and has at least about 50.0%, at least about 60.0%, at least about 70.0%, at least about 80.0%, at least about 85.0%, at least about 90.0%, at least about 95.0%, at least about 98.0% and at least about 99.0% identity to a contiguous amino acid sequence, without any insertions or deletions, as set forth in SEQ ID NO: 33 can be employed in the compositions, fusion proteins and methods of the invention.

Exemplary fusion proteins of the invention that include influenza antigens, such as SEQ ID NOs: 451-453, 455, 457, 460, 463-465, 468, 470-474, 500-506, 511-518, 660, 664, 703, 705, 707, 709, 711, 713, 715, 717, 719, 721, 723, 725, 729, 731, 733, 735, 737, 739, 741, 743, 745, 747, 749, 751, 753, 755, 757, 759, 761, 763 and 801-812.

In yet another embodiment, the invention is a composition that includes at least a portion of at least one antigen (e.g., an influenza antigen, an HPV antigen, and RSV antigen, a flavivirus antigen) and at least one member selected from the group consisting of an R0 construct, an R3 construct, an R3D0 construct, an D3N construct, an D3NCs construct and an D0D2D3 construct. Exemplary D0D2D3 constructs include SEQ ID NOs: 33, 823, 824 and 825.

In still another embodiment, the invention is a method of stimulating an immune response in a subject, comprising the step of administering to the human a composition that includes a fusion proteins of the invention. The subject can be administered fusion proteins that include at least one member selected from the group consisting of SEQ ID NOs: 451-453, 455, 457, 460, 463-465, 468, 470-474, 500-506, 511-518, 660, 664, 703, 705, 707, 709, 711, 713, 715, 717, 719, 721, 723, 725, 729, 731, 733, 735, 737, 739, 741, 743, 745, 747, 749, 751, 753, 755, 757, 759, 761, 763 and 801-812. In a particular embodiment, the fusion protein is administered to the human in at least one dose selected from the group consisting of about a 10.0 µg dose, about a 5.0 µg dose, about a 3.0 µg dose, about a 2.5 µg dose, about a 1.0 µg dose, about a 0.5 µg dose, about a 0.3 µg dose, about a 0.25 µg dose, about a 0.1 µg dose, about a 0.05 µg dose, about a 0.025 µg dose and about a 0.01 µg dose.

"Stimulating an immune response," as used herein, refers to the generation of antibodies and/or T-cells to at least a portion of an antigen (e.g., HA antigens, M2 antigens, RSV antigens, human papilloma virus (HPV) antigens, flaviviral antigens). The antibodies and/or T-cells can be generated to at least a portion of an antigen. Stimulating an immune response in a subject can include the production of humoral and/or cellular immune responses that are reactive against the antigen.

The compositions of the invention for use in methods to stimulate immune responses in subjects, can be evaluated for the ability to stimulate an immune response in a subject using well-established methods. Exemplary methods to determine whether the compositions of the invention stimulate an immune response in a subject, include measuring the production of antibodies specific to the antigen (e.g., IgG antibodies) by a suitable technique such as, ELISA assays; the potential to induce antibody-dependent enhancement (ADE) of a secondary infection; macrophage-like assays; neutralization assessed by using the Plaque Reduction Neutralization Test ($PRNT_{80}$) for influenza antigens; and the ability to generate serum antibodies in non-human models (e.g., mice, rabbits, monkeys) (Putnak, et al., *Vaccine* 23:4442-4452 (2005)).

"Stimulates a protective immune response," as used herein, means administration of the compositions of the invention results in production of antibodies to the protein to thereby cause a subject to survive challenge by a dose of a viral protein, for example, consequent to exposure to the subject to a virus or to an otherwise lethal dose of a viral protein. A protective immune response would also be stimulated in a subject if the subject exhibited minimal signs of illness following exposure to the virus.

Techniques to determine doses of the compositions and fusion proteins of the invention that would provide protective immunity are known to one of skill in the art (see, for example, WHO/CDS/CSR/NCS2002.5 "WHO Manual on Animal Influenza Diagnosis and Surveillance" World Health Organization, Dept of Communicable Disease Surveillance and Response, WHO Global Influenza Programme; Harmon, M. W., et al., *J. Clin. Microbiol.* 26:333-337 (1988); Reed, L. J., et al., *Am. J. Hyg.* 27:493-497 (1938); Rose, T., et al., *J. Clin. Microbiol.* 37:937-943 (1999); Walls, H. H. et al., *J. Clin. Microbiol.* 23:240-245 (1986); Current Protocols in Immunology, 19.11.1-19.11.32, Cottey, R., et al., John Wiley & Sons, Inc (2001)). Exemplary techniques for determining a lethal dose can include administration of varying doses of virus and a determination of the percent of subjects (e.g., mice) that survive following administration of the dose of virus (e.g., $LD_{10}$, $LD_{20}$, $LD_{40}$, $LD_{50}$, $LD_{60}$, $LD_{70}$, $LD_{80}$, $LD_{90}$). For example, a lethal dose of a virus that results in the death of about 50% of a population of subjects is referred to as an "$LD_{50}$"; a lethal dose of a virus that results in the death of about 80% of a population of subjects is referred to herein as "$LD_{80}$"; a lethal dose of a virus that results in death of about 90% of a population of subjects is referred to herein as "$LD_{90}$."

For example, determination of the $LD_{90}$ for a composition or a fusion protein that includes an influenza viral antigen can be conducted in subjects (e.g., mice) by administering intranasally varying doses (e.g., dilutions, such as log and half-log dilutions of about $8 \times 10^3$ egg-infectious doses (EID)) followed by an assessment of the survival of the subjects about 14 days to about 21 days after infection with the virus. Protective immunity can be assessed by physical appearance of the subject, general demeanor (active), weight (initial loss of weight followed by return to a weight about the weight of the subject prior to infection with the virus) and survival after about 14 to about 21 days following infection with the virus.

Assessment of stimulation of protective immunity for influenza antigens can also be made by employing assays that assess the ability of the antibodies produced in response to the compositions of the invention (e.g., a portion of the protein of the naturally occurring virus, such as a protein portion of hemagglutinin) to neutralize binding of the viral protein (e.g., hemagglutinin protein) to a host cell (see, for example, Current Protocols in Immunonology, 19.11.1-19.11.32, Cottey, R., et al., John Wiley & Sons, Inc (2001)). Assessment of stimulation of protective immunity can also be made by employing assays that measure the ability of antibodies to inhibit hemagglutinin binding (see, for example, Burnett, F. M., et al., J. exp. Biol. Med. Sci. 25:227-233 (1947); Salk, J. E. J. Immunol. 49:87-98 (1944); Current Protocols in Immunology, 19.11.1-19.11.32, Cottey, R., et al., John Wiley & Sons, Inc (2001)).

It is believed that inhibition of hemagglutinin binding is indicative of the ability of antibodies, formed from the compositions and by the methods of the invention, to neutralize the sialic acid binding sites of the naturally occurring viral hemagglutinin ("neutralization of HA binding") and, thereby, prevent infection of the host cell as a consequence of stimulating a protective immune response. Inhibition or neutralization of hemagglutinin binding is believed to correlate with an ability of an immune response to protect against a lethal dose of virus.

Neutralization of HA binding can be assessed by in vitro assays (See, for example, Current Protocols in Immunology 19.11.1-19.11.32, Cottey, R., et al., Suppl. 42, John Wiley & Sons, Inc. (2001) and WHO Manual on Animal Influenza Diagnosis and Surveillance, Webster, R., et al., pages 28-36, 48-54, 82-92 (2002)). Exemplary viral neutralization assays rely on the ability of serum to specifically bind and prevent replication of influenza virus in culture, such as in the Madin-Darby Canine Kidney (MDCK) cell line. Briefly, cells are cultured in 96 well plates in the presence of a previously titered virus and the cytopathic effect of the replicating virus is observed under a microscope. To test serum, serial dilutions of the serum are prepared and preincubated with the viral stock for about 2 hours at 37° C. prior to infecting the MDCK cells. The mixture is incubated for an additional 2 hours after which the virus/serum mixture is removed and replaced with fresh media. The cells are grown for 4 days. Wells are scored as positive for viral growth if at least about 50% of the cells are dead in at least about half of the wells for a given serum dilution. The reciprocal of the highest dilution of serum which protects at least about half of the cells from death, in at least about half of the wells, is considered the neutralization titer.

Alternatively, a micro-neutralization in vitro assay can be performed to assess neutralization of HA binding. For example, serum is diluted and preincubated with a known titer of virus and mixed with MDCK cells, as described above. After 2 days of incubation, cells are washed and fixed with acetone. The plates are developed as an ELISA using a monoclonal antibody to the influenza nuclear antigen NP. A microneutralization titer is determined as the reciprocal of the highest dilution which yields less than about 50% of the anti-NP reading of the virus-only control wells.

The Hemagglutination Inhibition (HAI) assay is based on the HA antigen on the surface of the influenza virus agglutinating red blood cells (RBC) and preventing red blood cells from precipitating. Antibodies that specifically bind the sialic acid-binding regions of HA prevent agglutination allowing precipitation. The assay is performed in 96 well V bottom plates with fresh chicken RBC. A stock of viral antigen is titered so that about a 4-fold excess of antigen is present relative to the minimum amount needed to prevent precipitation. The test serum, which can be from several species including mouse, ferret, poultry or human, is heated to about 56° C. to inactivate complement. Serial 2-fold dilutions of the inactivated serum are performed and mixed with the stock HA. After about 30 minutes at room temperature, the RBCs are added and the plate is incubated for about 30 to about 45 minutes. Results are scored by observations: agglutination results in cloudy wells while inhibition results in a "button" of red cells precipitated at the bottom of the well. Controls include RBC with no HA, which forms a button, and HA and RBC with no serum, which remains cloudy. The HAI titer of a particular serum sample is the reciprocal of the last dilution which prevents agglutination (i.e., forms a button). For example, if about a 1:128 dilution reads as a button but the 1:256 dilution does not, the HAI titer is about 128.

Exemplary techniques to determine protective immunity of compositions and fusion proteins that include HPV antigens, include determination of the LD90 in subjects (e.g., mice) by implanting subcutaneously varying doses (e.g., dilutions, such as log and half-log dilutions) of mouse TC-1 lung tumor cells and measuring tumor volume for about 5 to about 6 weeks post-implantation. Protective immunity in experimentally-immunized mice compared to non-immunized mice can be assessed, for example, by measuring a reduction in tumor volume, a delay in onset of tumor growth, or an increase in survival time of the experimentally-immunized host compared to the non-immunized host (Bermúdez-Humarán, Luis G, et al., *J. Immunol.,* 175: 7297-7302 (2005); Qian, X, et al., *Immunol Lett.,* 102:191-201 (2006)).

Papillomaviruses are DNA-viruses that infect the skin and mucous membranes of humans and a variety of animals. Over 100 different human papillomavirus (HPV) types have been identified. HPVs are transmitted by skin-to-skin contact. HPV infection can result in the abnormal growth and proliferation of infected cells. Gardasil® is a vaccine to prevent infection with some types of HPV (6, 11, 16, and 18), but is generally effective only if administered before an individual is infected with HPV and before the human develops an HPV-induced cancer. There is a need to develop new, improved and effective methods of treatment for preventing and managing disease associated with HPV infection.

Techniques to assess protective immunity of compositions and fusion proteins that include RSV antigens include, for example, determination of the LD90 in subjects (e.g., mice) by administering intranasally varying doses (e.g., dilutions, such as log and half-log dilutions) followed by an assessment of the survival of the subjects about 14 days to about 21 days after infection with the virus. Protective immunity can be assessed by physical appearance of the subject, general demeanor (active), weight (initial loss of weight followed by return to a weight about the weight of the subject prior to infection with the virus) and survival after about 14 to about 21 days following infection with the virus.

Respiratory syncytial virus (RSV) infection can lead to disease. RSV can result in respiratory tract infections and is a major cause of lower respiratory tract infection during infancy and childhood. Generally, natural infection with RSV does not necessarily prevent illness from subsequent RSV infection. Strategies to manage disease associated with RSV infection can include antibodies to RSV proteins and antiviral agents. However, such strategies may result in variable protection and less than satisfactory alleviation of symptoms, thereby ineffectively preventing or treating illness associated with RSV infection. There is a need to develop new, improved and effective methods of treatment for preventing and managing disease associated with RSV infection.

Thus, administration of the compositions and fusion proteins of the invention can provide protective immunity against an infection consequent to exposure of the human to a source of the antigen. The compositions and fusion proteins of the invention can be employed as vaccines to prevent disease and to minimize the clinical syndromes of illness consequent to exposure to the viral antigen.

The flagellin constructs described herein, for example STF2, STF2Δ, an R0 construct, an R3 construct, an R3D0 construct, an R03 construct, an R3-2xAg construct, an D3N construct, an D3NCs construct and an D1 construct, can have different immunogenicity (e.g., the ability to generate antibodies to the flagellin component and antigen component of a fusion protein when the construct is fused to an antigen) and reactogenicity (e.g., production of side-effects) profiles, which may also vary depending on the antigen that is fused to the flagellin construct. The varied immunogenicity and reactogenicity profiles may be useful in methods to stimulate an immune response or protective immunity in subjects associated with different immunological experiences.

For example, as described herein, a fusion protein that includes an R0 construct and a portion of an HA antigen is moderately immunogenic in a rabbit model and importantly has low reactogenicity, which may be useful in compositions in which either the subject is immunologically naïve to the antigen (e.g., the subject has not previously been exposed to the antigen) and large amounts of the antigen are required to prime a response; or when multiple antigens are utilized to form a multivalent vaccine and the overall load of flagellin is high. In these instances, the need for low reactogenicity outweighs the need for immunopotentiation. Immunologically naïve circumstances can include, for example, application for a pandemic breakout or transmission of a virus between species, such as from a bird to a human. Circumstances utilizing a multivalent vaccine would include, for example, seasonal influenza, in which antigens corresponding to multiple subtypes of influenza are delivered together in a single vaccine.

In contrast, there are instances, or more specifically antigens, in which the need for immunopotentiation is high. This could relate to varying forms of an antigen, such as the influenza virus, for which some of the subtypes, such as Influenza B or H5, are poorly immunogenic. As described herein, a fusion protein that includes an R32x construct and an influenza antigen elicits a strong immunological response to the influenza antigen with low reactogenicity.

In still another embodiment, the invention is a nucleic acid sequence encoding the amino acid sequences and fusion proteins of the invention. The isolated nucleic acid can include deletion of at least one glycosylation site in the isolated nucleic acid sequence. The nucleic acid sequence can be altered or mutated to delete a glycosylation site that includes a putative N-glycosylation site, which can be determined by the consensus sequence NXS or NXT, where the "X" is any amino acid. Mutation of a putative glycosylation site can be at least one member selected from the group consisting of at least a portion of at least one flagellin component of a fusion protein, at least a portion of one TLR agonist (e.g., TLR5 agonist) and at least a portion of at least one antigen component of the fusion protein. For example, at least one member selected from the group consisting of amino acid residues 19, 101, 292, 356 and 375 of SEQ ID NO: 29 can be mutated to delete the putative glycosylation site. The mutation of the asparagine (D) residue in the putative glycosylation site can be a mutation to any amino acid sequence, such as glutamine (Q) or aspartic acid.

Likewise, at least one member selected from the group consisting of amino acid residues 55, 347 and 411 of SEQ ID NO: 28 can be mutated to delete the putative glycosylation site; at least one member selected from the group consisting of amino acid residues 19, 101, 292, 356 and 375 of SEQ ID NO: 29 can be mutated to delete the putative glycosylation site; at least one member selected from the group consisting of amino acid residues 55, 246, 310 and 329 of SEQ ID NO: 30 can be mutated to delete the putative glycosylation site; at least one member selected from the group consisting of amino acid residues 55, 246, 310 and 329 of SEQ ID NO: 31 can be mutated to delete the putative glycosylation site; at least one member selected from the group consisting of amino acid residues 55, 246, 310 and 329 of SEQ ID NO: 32 can be mutated to delete the putative glycosylation site; at least one member selected from the group consisting of amino acid residues 55 and 173 of SEQ ID NO: 33 can be mutated to delete the putative glycosylation site.

The amino acid sequences of the invention can be components of compositions. A composition can include at least a portion of a naturally occurring flagellin protein, wherein the portion includes, in sequence, an amino-domain 0, an amino-domain 1, an amino-domain 2, a carboxy-domain 2, a carboxy-domain 1 and a carboxy-domain 0, for example, SEQ ID NO: 29.

"At least a portion," as used herein in reference to a naturally occurring flagellin protein, refers to a part of the naturally occurring flagellin that is less than the entire naturally occurring flagellin. "Naturally occurring," as used herein, refers to the entire flagellin, as it occurs in nature. A naturally occurring flagellin has an amino-domain 0, amino-domain 1, an amino-domain 2, a domain 3, a carboxy-domain 2, a carboxy-domain 1 and a carboxy-domain 0 (see, for example, SEQ ID NOs: 12 and 22), as shown herein. A portion of a flagellin is designed based on the crystal structure of flagellin, which depicts the amino-domain 0, the amino-domain 1, the amino-domain 2, the domain 3, the carboxy-domain 2, the carboxy-domain 1 and the carboxy-domain 0 of S. typhimurium flagellin as described in Yonekura, K., et al., Nature 424: 643-650 (2003).

The compositions that include the amino acid sequences of the invention can further include at least a portion of at least one antigen. The portion of the naturally occurring flagellin protein and the antigen can be components of a fusion protein in the composition. In an embodiment, the antigen can be fused to the portion of the naturally occurring flagellin protein between the amino-domain 2 and the carboxy-domain 2 (an R3 construct), which can further, optionally, include fusing at least a portion of at least one additional antigen to the carboxy-domain 0 of the portion of the naturally occurring flagellin protein (an R3-2XAg construct). The antigen and the additional antigen (also referred to herein as "one other antigen") can be distinct or similar antigens. In another embodiment, the antigen is fused to the carboxy-domain 0 of the portion of the naturally occurring flagellin protein (the D3 construct).

A composition of the invention can include a portion of a naturally occurring flagellin protein, wherein the portion includes, in sequence, an amino-domain 1, an amino-domain 2, a carboxy-domain 2 and a carboxy-domain 1 (for example, SEQ ID NO: 30), which can further include at least a portion of at least one antigen that can, optionally, be fused to the naturally occurring flagellin protein to form a fusion protein. The antigen can be fused to the portion of the naturally occurring flagellin protein between the amino-domain 2 and the carboxy-domain 2 (an R3D0 construct) and can, optionally, further include at least a portion of at least one additional antigen fused to the carboxy-domain 1 of the portion of the naturally occurring flagellin protein (an R03 construct).

A composition of the invention can include a portion of a naturally occurring flagellin protein, wherein the portion includes, in sequence, an amino-domain 1, an amino-domain 2, a carboxy-domain 2, a carboxy-domain 1 and a carboxy-domain 0 (D3N) and can further, optionally, include fusing at least a portion of at least one antigen to the carboxy-domain 0 of the portion of the naturally occurring flagellin protein.

A composition of the invention can include a portion of a naturally occurring flagellin protein, wherein the portion includes, in sequence, an amino-domain 1, an amino-domain 2, a carboxy-domain 2, a carboxy-domain 1 and at least a portion of a carboxy-domain 0 (D3NCs) and can further, optionally, include at least a portion of at least one antigen fused to the carboxy-domain 0.

A composition of the invention can include a portion of a naturally occurring flagellin protein, wherein the portion includes, in sequence, an amino-domain 1, an amino-domain 2, a carboxy-domain 2 and a carboxy-domain 1 and wherein the portion of the naturally occurring flagellin lacks a portion of a carboxy-domain 0 (D3NCs).

A composition of the invention can include a portion of a naturally occurring flagellin protein, wherein the portion includes, in sequence, an amino-domain 1 and a carboxy-domain 1 (D1) and can further, optionally, include at least a portion of at least one antigen fused to the carboxy-domain 1.

The flagellin in the compositions, fusion proteins and methods described herein can be at least a portion of a *S. typhimurium* flagellin (GenBank Accession Number AF045151); at least a portion of the *S. typhimurium* flagellin selected from the group consisting of SEQ ID NO: 12, SEQ ID NO: 13, SEQ ID NO:14 and SEQ ID NO: 15; at least a portion of an *S. muenchen* flagellin (GenBank Accession Number AB028476) that includes at least a portion of SEQ ID NO: 16 and SEQ ID NO: 17; at least a portion of *P. aeruginosa* flagellin that includes at least a portion of SEQ ID NO: 18; at least a portion of a *Listeria monocytogenes* flagellin that includes at least a portion of SEQ ID NO: 19; at least a portion of an *E. coli* flagellin that includes at least a portion of SEQ ID NO: 20 and SEQ ID NO: 21; at least a portion of a *Yersinia* flagellin; and at least a portion of a *Campylobacter* flagellin.

Compositions and fusion proteins of the invention that include amino acid sequences that activate Toll-like Receptor 5 (e.g., SEQ ID NOs: 29-34) can further include at least one Toll-like Receptor (TLR) agonist selected from the group consisting of a Toll-like Receptor 2 agonist, a Toll-like Receptor 3 agonist, a Toll-like Receptor 4 agonist, a Toll-like Receptor 6 agonist, a Toll-like Receptor 7 agonist, a Toll-like Receptor 8 agonist, a Toll-like Receptor 9 agonist and a Toll-like Receptor 10 agonist, which can be administered to subjects in combination with the amino acid sequences that activate TLR 5 and fusion proteins of the invention. These additional TLR agonists can be administered in combination or sequentially with the flagellin constructs and fusion proteins of the invention.

"Agonist," as used herein in referring to a TLR, means a molecule that activates a TLR signaling pathway. A TLR signaling pathway is an intracellular signal transduction pathway employed by a particular TLR that can be activated by a TLR ligand or a TLR agonist. Common intracellular pathways are employed by TLRs and include, for example, NF-κB, Jun N-terminal kinase and mitogen-activated protein kinase. The Toll-like Receptor agonist can include at least one member selected from the group consisting of a TLR1 agonist, a TLR2 agonist (e.g., Pam3Cys, Pam2Cys, bacterial lipoprotein), a TLR3 agonist (e.g., dsRNA), a TLR4 agonist (e.g., bacterial lipopolysaccharide), a TLR5 agonist (e.g., a flagellin), a TLR6 agonist, a TLR7 agonist, a TLR8 agonist, a TLR9 agonist (e.g., unmethylated DNA motifs), TLR10 agonist, a TLR11 agonist and a TLR12 agonist. Exemplary suitable Toll-like Receptor agonist components for use in the invention are described, for example, in U.S. application Ser. No. 11/820,148, now abandoned, Ser. No. 11/879,695, now U.S. Pat. No. 8,574,588, Issued Nov. 5, 2013, Ser. No. 11/714,873, now U.S. Pat. No. 8,420,102, Issued Apr. 16, 2013, and Ser. No. 11/714,684, now abandoned, the entire teachings of all of which are hereby incorporated by reference in their entirety.

TLR4 ligands (e.g., TLR4 agonists) for use in the compositions and methods of the invention can include TL4 ligands described in PCT/US 2006/002906/WO 2006/083706; PCT/US 2006/003285/WO 2006/083792; PCT/US 2006/041865; PCT/US 2006/042051, for example, GGKSGRTG (SEQ ID NO: 1), KGYDWLVVG (SEQ ID NO: 2) and EDMVYRIGVP (SEQ ID NO: 3).

TLR2 ligands (e.g., TLR2 agonists) for use in the compositions and methods of the invention can also include TLR2 ligands described in PCT/US 2006/002906/WO 2006/083706; PCT/US 2006/003285/WO 2006/083792; PCT/US 2006/041865; PCT/US 2006/042051, for example, NPPTT (SEQ ID NO: 4), MRRIL (SEQ ID NO: 5), MISS (SEQ ID NO: 6) and RGGSK (SEQ ID NO:7).

The TLR2 ligand (e.g., TLR2 agonist) can also include at least a portion of at least one member selected from the group consisting of flagellin modification protein FlmB of *Caulobacter crescentus*; Bacterial Type III secretion system protein; invasin protein of *Salmonella*; Type 4 fimbrial biogenesis protein (PilX) of *Pseudomonas*; *Salmonella* SciJ protein; putative integral membrane protein of *Streptomyces*; membrane protein of *Pseudomonas*; adhesin of *Bordetella pertusis*; peptidase B of *Vibrio cholerae*; virulence sensor protein of *Bordetella*; putative integral membrane protein of *Neisseria meningitidis*; fusion of flagellar biosynthesis proteins FliR and FlhB of *Clostridium*; outer membrane protein (porin) of Acinetobacter; flagellar biosynthesis protein FlhF of *Helicobacter*; ompA related protein of *Xanthomonas*; omp2a porin of *Brucella*; putative porin/fimbrial assembly protein (LHrE) of *Salmonella*; wbdk of *Salmonella*; Glycosyltransferase involved in LPS biosynthesis; *Salmonella* putative permease.

The TLR2 ligand (e.g., TLR agonist) can include at least a portion of at least one member selected from the group consisting of lipoprotein/lipopeptides (a variety of pathogens); peptidoglycan (Gram-positive bacteria); lipoteichoic acid (Gram-positive bacteria); lipoarabinomannan (mycobacteria); a phenol-soluble modulin (*Staphylococcus epidermidis*); glycoinositolphospholipids (*Trypanosoma Cruzi*); glycolipids (*Treponema maltophilum*); porins (*Neisseria*); zymosan (fungi) and atypical LPS (*Leptospira interrogans* and *Porphyromonas gingivalis*).

The TLR2 ligand (e.g., TLR2 agonist) can also include at least one member selected from the group consisting of (see, PCT/US 2006/002906/WO 2006/083706; PCT/US 2006/003285/WO 2006/083792; PCT/US 2006/041865; PCT/US 2006/042051).

The TLR2 agonist can include at least a portion of a bacterial lipoprotein (BLP).

The TLR2 agonist can be a bacterial lipoprotein, such as Pam2Cys (S-[2,3-bis(palmitoyloxy)propyl]cysteine), Pam3Cys ([Palmitoyl]-Cys((RS)-2,3-di(palmitoyloxy)-propyl cysteine) or *Pseudomonas aeruginosa* OprI lipoprotein (OprI). Exemplary OprI lipoproteins include SEQ ID NO: 8, encoded by SEQ ID NO: 9. An exemplary protein component of an *E. coli* bacterial lipoprotein for use in the invention described herein is SEQ ID NO: 10 encoded by SEQ ID NO: 11. A bacterial lipoprotein that activates a TLR2 signaling pathway (a TLR2 agonist) is a bacterial protein that includes a palmitoleic acid (Omueti, K. O., et al., *J. Biol. Chem.* 280: 36616-36625 (2005)). For example, expression of SEQ ID NOs: 9 and 11 in bacterial expression systems (e.g., *E. coli*) results in the addition of a palmitoleic acid moiety to a cysteine residue of the resulting protein (e.g., SEQ ID NOs: 8 and 10) thereby generating a TLR2 agonist for use in the compositions, fusion proteins and polypeptides of the invention. Production of tripalmitoylated-lipoproteins (also referred to as triacyl-lipoproteins) in bacteria occurs through the addition of a diacylglycerol group to the sulfhydryl group of a cysteine (e.g., cysteine 21 of SEQ ID NO: 10) followed by cleavage of the signal sequence and addition of a third acyl chain to the free N-terminal group of the same cysteine (e.g., cysteine 21 of SEQ ID NO: 10) (Sankaran, K., et al., J. Biol. Chem. 269:19706 (1994)), to generate a tripalmitylated peptide (a TLR2 agonist).

The Toll-like Receptor agonist in the compositions of the invention can further include at least one cysteine residue at the terminal amino acid of the amino-terminus and/or the terminal amino acid of the amino or carboxy-terminus of the Toll-like Receptor agonist. For example, RGGSK (SEQ ID NO: 7) can further include at least one cysteine residue in a peptide bond to the amino- or carboxy-terminal residue.

The Toll-like Receptor agonists for use in the methods and compositions of the invention can also be a Toll-like Receptor agonist component that is at least a portion of a Toll-like Receptor agonist that includes at least one cysteine residue in a position where a cysteine does not occur in the native Toll-like Receptor agonist and the Toll-like Receptor agonist component activates a Toll-like Receptor. The cysteine residue can be an addition to the native Toll-like Receptor agonist, such as TLR5 agonist (e.g., flagellin) or flagellin constructs (e.g., an R0 construct, an R3 construct, an R3D0 construct, an R03 construct, an D3N construct, an D3NCs construct, an D1 construct). Alternatively, or additionally, the cysteine residue can be substituted for an amino acid in the naturally occurring flagellin or in a TLR5 agonist or flagellin construct of the invention. The addition of a cysteine or cysteine substitution can be accomplished by recombinant methods by alternating nucleic acid sequences to encode cysteine residues in the flagellin, TLR5, or flagellin construct employing well-known techniques.

The cysteine residue that substitutes for at least one amino acid residue in a naturally occurring flagellin amino acid sequence of the flagellin component can be remote to at least one amino acid of the Toll-like Receptor 5 recognition site of the flagellin component. "Toll-like Receptor 5 recognition site," means that part of the TLR5 ligand (e.g., TLR5 agonist) that interacts with TLR5 to mediate a cellular response. "Toll-like Receptor 5 recognition site" is also referred to as a "Toll-like Receptor 5 activation site" and a "Toll-like Receptor 5 activation domain."

Likewise, "Toll-like Receptor recognition site," means that part of the Toll-like Receptor ligand (e.g., a Toll-like Receptor agonist) that interacts with its respective TLR to mediate a cellular response. "Toll-like Receptor recognition site" is also referred to as a "Toll-like Receptor activation site" and a "Toll-like Receptor activation domain."

The antigen component of a fusion protein can be chemically conjugated to flagellin components (e.g., R0 construct, R3 construct, R3D0 construct, R03 construct, R3-2xAg construct, D3N construct, D3NCs construct and D1 construct) and Toll-like Receptor agonist components. Chemical conjugation (also referred to herein as "chemical coupling") can include conjugation by a reactive group, such as a thiol group (e.g., a cysteine residue) or by derivatization of a primary (e.g., a amino-terminal) or secondary (e.g., lysine) group. Different crosslinkers can be used to chemically conjugate flagellin components to the antigen component. Exemplary cross linking agents are commerically available, for example, from Pierce (Rockland, Ill.). Methods to chemically conjugate the antigen component to the flagellin component are well-known and include the use of commercially available cross-linkers, such as those described herein.

For example, conjugation of an antigen component to a flagellin component, a Toll-like Receptor agonist component or a flagellin construct (e.g., an R0 construct, an R3 construct, an R3D0 construct, an R03 construct, an D3N construct, an D3NCs construct, an D1 construct) of the invention can be through at least one cysteine residue of the flagellin component, the Toll-like Receptor component or the flagellin construct and at least one cysteine residue of an antigen component employing established techniques. The antigen component can be derivatized with a homobifunctional, sulfhydryl-specific crosslinker; desalted to remove the unreacted crosslinker; and then the partner added and conjugated via at least one cysteine residue cysteine. Exemplary reagents for use in the conjugation methods can be purchased commercially from Pierce (Rockland, Ill.), for example, BMB (Catalog No: 22331), BMDB (Catalog No: 22332), BMH (Catalog No: 22330), BMOE (Catalog No: 22323), BM[PEO]$_3$ (Catalog No: 22336), BM[PEO]$_4$ (Catalog No:22337), DPDPB (Catalog No: 21702), DTME (Catalog No: 22335), HBVS (Catalog No: 22334).

Alternatively, the antigen component can also be conjugated to lysine residues on flagellin components, flagellin, Toll-like Receptor agonist components, Toll-like Receptor agonists or flagellin constructs of the invention. A protein component containing no cysteine residues is derivatized with a heterobifunctional amine and sulfhydryl-specific crosslinker. After desalting, the cysteine-containing partner is added and conjugated. Exemplary reagents for use in the conjugation methods can be purchased from Pierce (Rockland, Ill.), for example, AMAS (Catalog No: 22295), BMPA (Catalog No. 22296), BMPS (Catalog No: 22298), EMCA (Catalog No: 22306), EMCS (Catalog No: 22308), GMBS (Catalog No: 22309), KMUA (Catalog No: 22211), LC-SMCC (Catalog No: 22362), LC-SPDP (Catalog No: 21651), MBS (Catalog No: 22311), SATA (Catalog No: 26102), SATP (Catalog No: 26100), SBAP (Catalog No: 22339), SIA (Catalog No: 22349), SIAB (Catalog No: 22329), SMCC (Catalog No: 22360), SMPB (Catalog No: 22416), SMPH (Catalog No. 22363), SMPT (Catalog No: 21558), SPDP (Catalog No: 21857), Sulfo-EMCS (Catalog No: 22307), Sulfo-GMBS (Catalog No: 22324), Sulfo-KMUS (Catalog No: 21111), Sulfo-LC-SPDP (Catalog No: 21650), Sulfo-MBS (Catalog No: 22312), Sulfo-SIAB (Catalog No: 22327), Sulfo-SMCC (Catalog No: 22322), Sulfo-SMPB (Catalog No: 22317), Sulfo-LC-SMPT (Catalog No.: 21568).

Additionally, or alternatively, the antigen components can also be conjugated to flagellin components, Toll-like Receptor agonist components, such as flagellin constructs, of the invention by at least one lysine residue on both conjugate partners. The two conjugate partners are combined along with a homo-bifunctional amine-specific crosslinker. The appropriate hetero-conjugate is then purified away from unwanted aggregates and homo-conjugates. Exemplary reagents for use in the conjugation methods can be purchased from Pierce (Rockland, Ill.), for example, BSOCOES (Catalog No: 21600), BS$_3$ (Catalog No: 21580), DFDNB (Catalog No: 21525), DMA (Catalog No: 20663), DMP (Catalog No: 21666), DMS (Catalog No: 20700), DSG (Catalog No: 20593), DSP (Catalog No: 22585), DSS (Catalog No: 21555), DST (Catalog No: 20589), DTBP (Catalog No: 20665), DTSSP (Catalog No: 21578), EGS (Catalog No: 21565), MSA (Catalog No: 22605), Sulfo-DST (Catalog No: 20591), Sulfo-EGS (Catalog No: 21566), THPP (Catalog No: 22607).

Similarly, protein components can be conjugated to flagellin components, Toll-like Receptor agonist components or the flagellin constructs of the invention by at least one carboxyl group (e.g., glutamic acid, aspartic acid, or the carboxy-terminus of the peptide or protein) on one partner and amines on the other partner. The two conjugation partners are mixed together along with the appropriate heterobifunctional crosslinking reagent. The appropriate hetero-conjugate is then purified away from unwanted aggregates and homo-conjugates. Exemplary reagents for use in the conjugation methods can be purchased from Pierce (Rockland, Ill.), for example, AEDP (Catalog No: 22101), EDC (Catalog No: 22980) and TFCS (Catalog No: 22299).

At least one cysteine residue can be substituted for at least one amino acid in a naturally occurring flagellin amino acid sequence flagellin component, flagellin or flagellin construct of the invention. The cysteine residue can substitute for at least one amino acid selected from the group consisting of amino acid 1, 237, 238, 239, 240, 241 and 495 of SEQ ID NO:13; at least one amino acid selected from the group consisting of amino acid 1, 240, 241, 242, 243, 244 and 505 of SEQ ID NO: 12; at least one amino acid selected from the group consisting of amino acid 1, 237, 238, 239, 240, 241 and 504 of SEQ ID NO: 16; at least one amino acid selected from the group consisting of amino acid 1, 211, 212, 213 and 393 of SEQ ID NO: 18; at least one amino acid selected from the group consisting of amino acid 1, 151, 152, 153, 154 and 287 of SEQ ID NO: 19; at least one amino acid selected from the group consisting of amino acid 1, 238, 239, 240, 241, 242, 243 and 497 of SEQ ID NO: 20; at least one amino acid selected from the group consisting of amino acid 1, 237, 238, 239, 240, 241 and 495 of SEQ ID NO: 13. Flagellin or flagellin constructs, such as an R0 construct, an R3 construct, an R3D0 construct, an R03 construct, an R3-2x Ag construct, a D3N construct, a D3NCs construct and a D1 construct, in which a cysteine substitutes for an amino acid in a naturally occurring flagellin can be used to chemically conjugate the flagellin component to an antigen. Cysteine residues can also be added to the naturally occurring amino acid sequence of a flagellin or flagellin construct of the invention.

A cysteine residue can be placed within the D1/D2 domain proximate to the amino-terminus and carboxy-terminus, remote to the TLR5 recognition site. Alternatively, or additionally, the cysteine residue can be placed at the distal point of the hypervariable domain at about amino acid 237, about 238, about 239, about 240 and about 241 of SEQ ID NO: 13. Substituting polar or charged amino acids is preferable to substituting hydrophobic amino acids with cysteine residues. Substitution within the TLR5 recognition site is least preferable.

Flagellin from *Salmonella typhimurium* STF1 (FliC) is depicted in SEQ ID NO: 13 (Accession No: P06179). The TLR5 recognition site is amino acid about 79 to about 117 and about 408 to about 439 of SEQ ID NO: 13. Cysteine residues can substitute for or be included in combination with amino acids outside of TLR5 recognition site, for example, amino acids about 237 to about 241 of SEQ ID NO: 13.

*Salmonella typhimurium* flagellin STF2 (FljB) is depicted in SEQ ID NO: 12. The TLR5 recognition site is amino acids about 80 to about 118 and about 420 to about 451 of SEQ ID NO: 12. Cysteine residues can substitute for or be included in combination with amino acids outside of the TLR5 recognition site, for example amino acids about 240 to about 244 of SEQ ID NO: 12.

*Salmonella muenchen* flagellin is depicted in SEQ ID NO: 16 (Accession No: #P06179). The TLR5 recognition site is amino acids about 79 to about 117 and about 418 to about 449 of SEQ ID NO: 16. Cysteine residues can substitute for or be included in combination with amino acids outside of the TLR5 recognition site, for example, amino acids about 237 to about 241 of SEQ ID NO: 16.

*Escherichia coli* flagellin is depicted in SEQ ID NO: 20 (Accession No: P04949). The TLR5 recognition site is amino acids about 79 to about 117 and about 410 to about 441 of SEQ ID NO: 20. Cysteine residues can substitute for or be included in combination with amino acids outside of the TLR5 recognition site, for example, amino acids about 238 to about 243 of SEQ ID NO: 20.

*Pseudomonas auruginosa* flagellin is depicted in SEQ ID NO: 18. The TLR5 recognition site is amino acids about 79 to about 114 and about 308 to about 338 of SEQ ID NO: 18. Cysteine residues can substitute for or be included in combination with amino acids outside of the TLR5 recognition site, for example, amino acids about 211 to about 213 of SEQ ID NO: 18.

*Listeria monocytogenes* flagellin is depicted in SEQ ID NO: 19. The TLR5 recognition site is amino acids about 78 to about 116 and about 200 to about 231 of SEQ ID NO: 19. Cysteine residues can substitute for or be included in combination with amino acids outside of the TLR5 recognition site, for example, amino acids about 151 to about 154 of SEQ ID NO: 19.

Experimentally defined TLR5 recognition sites on STF2 have been described (see, for example, Smith, K. D., et al., *Nature Immunology* 4:1247-1253 (2003) at amino acids about 79 to about 117 and about 420 to about 451. In addition, Smith, K. D., et al., *Nature Immunology* 4:1247-1253 (2003), based on sequence homology, identified TLR5 recognition sites on other flagellins, such as STF1 at amino acids about 79 to about 117, about 408 to about 439; *P. aeruginosa* at amino acids about 79 to about 117, about 308 to about 339; *L. pneumophila* at amino acids about 79 to about 117, about 381 to about 419; *E. coli* at amino acids about 79 to about 117, about 477, about 508; *S. marcesens* at amino acids about 79 to about 117, about 265-about 296; *B. subtilus* at amino acids about 77 to about 117, about 218 to about 249; and *L. monocytogenes* at amino acids about 77 to about 115, about 200 to about 231.

The high-resolution structure STF1 (FliC) (SEQ ID NO: 13) has been determined and can be a basis for analysis of TLR5 recognition by a flagellin and the location of cysteine substitutions/additions. The region of greatest sequence homology of flagellins is in the TLR5 recognition site, which includes the D1 and D0 domain. D1 and D2 domain 1 and domain 0, which include the TLR5 recognition site. The region of least sequence homology between flagellins is the hypervariable region.

It is believed that the ability of the flagellin component, Toll-like Receptor agonist component or the flagellin construct to activate TLR5 can be accomplished by maintaining the conjugation sites (cysteine residues substituted for at least one amino acid in a naturally occurring flagellin amino acid sequence flagellin component or at least a portion of a naturally occurring flagellin amino acid sequence in combination with the cysteine residue) remote from the TLR5 or TLR recognition site. For example, for STF1 (SEQ ID NO: 13), for which a high resolution structural determination is available, this may be achieved in the D1 domain, D2 domain or in the hinge region. In the D1/D2 domain the amino- and carboxy-termini can be remote (also referred to herein as "distal") from the TLR5 recognition site, and moving away from either the amino or carboxy terminus may bring the conjugation site closer to the recognition site and may interfere with TLR5 activity. In the hinge region amino acids about 237 to about 241 of SEQ ID NO: 13, are approximately at the other tip of the "boomerang" and are about the same distance from the TLR5 recognition site as the amino- and carboxy-termini. This site may also be a location that maintains TLR5 recognition.

Amino acid identity can be taken into consideration for the location of conjugation sites. Polar and charged amino acids (e.g., serine, aspartic acid, lysine) are more likely to be surface exposed and amenable to attachment of an antigen. Hydrophobic amino acids (e.g., valine, phenalalanine) are more likely to be buried and participate in structural interactions and should be avoided.

Compositions that include flagellin components with cysteine residues or Toll-like Receptor agonist components with cysteine residues activate TLR5 and can be chemically conjugated to antigens.

Cysteine residues (e.g., 1, 2, 3, 4, 5, 6, 7, 8 cysteine residues) can be added to or substituted for amino acids in antigens for chemical configuration to flagellin components of the invention. For example, cysteine residues in HPV antigens or RSV influenza antigens, flavivirus antigens, can be replaced (also referred to herein as "substituted") with a serine residue or an alanine residue.

The composition can include at least a portion of an antigen and a flagellin or flagellin construct that is at least a portion of a flagellin, wherein at least one lysine of the flagellin component or flagellin construct has been substituted with at least one other amino acid, such as an arginine, whereby the flagellin component activates a Toll-like Receptor 5.

"Substituted," as used herein in reference to the flagellin, flagellin component, flagellin construct Toll-like Receptor agonist or Toll-like Receptor agonist component, means that at least one amino acid, such as a lysine of the flagellin component, has been modified to another amino acid residue, for example, a conservative substitution (e.g., arginine, serine, histidine) to thereby form a substituted flagellin component or substituted Toll-like Receptor agonist component. The substituted flagellin component or substituted Toll-like Receptor agonist component can be made by generating recombinant constructs that encode flagellin with the substitutions, by chemical means, by the generation of proteins or peptides of at least a portion of the flagellin by protein synthesis techniques, or any combination thereof.

The lysine residue that is substituted with an amino acid (e.g., arginine, serine, histidine) can be at least one lysine residue selected from the group consisting of lysine 19, 41, 58, 135, 160, 177, 179, 203, 215, 221, 228, 232, 241, 251, 279, 292, 308, 317, 326, 338, 348, 357, 362, 369, 378, 384, 391 and 410 of SEQ ID NO: 13.

The flagellin can be a S. typhimurium flagellin that includes SEQ ID NO: 14. The lysine residue that is substituted with an amino acid (e.g., arginine, serine, histidine) can be at least one lysine residue selected from the group consisting of lysine 20, 42, 59, 136, 161, 177, 182, 189, 209, 227, 234, 249, 271, 281, 288, 299, 319, 325, 328, 337, 341, 355, 357, 369, 381, 390, 396, 403, 414 and 422 of SEQ ID NO: 14.

The flagellin can be an E. coli fliC that includes SEQ ID NO: 20. The flagellin can be a S. muenchen that include the includes SEQ ID NO: 17. The flagellin can be a P. aeruginosa flagellin that includes SEQ ID NO: 18. The flagellin can be a Listeria monocytogenes flagellin that includes SEQ ID NO: 19.

Certain lysine residues in flagellin are near or in domain 1, can be important in binding of the flagellin to TLR5. For example, lysine residues at amino acids 58, 135, 160 and 410 of SEQ ID NO: 13 may be substituted with at least one member selected from the group consisting of an arginine residue, a serine residue and a histidine residue. Derivatization of such lysine residues to, for example, chemically conjugated antigens to flagellins, may decrease the ability or the binding affinity of the flagellin to TLR5 and, thus, diminish an innate immune response mediated by TLR5. Substitution of at least one lysine residue in a flagellin that may be near to regions of the flagellin that are important in mediating interactions with TLR5 (e.g., domain 1) with another amino acid (e.g., arginine, serine, histidine) may preserve or enhance flagellin binding to TLR5. In a particular embodiment, the amino acid substitution is a conservative amino acid substitution with at least one member selected from the group consisting of arginine, serine and histidine. Exemplary commercially available reagents for chemical conjugation are described herein.

Certain lysine residues in flagellin are in the domain (domain 1) and can be important for activation of TLR5. For example, lysine residues at positions 58, 135, 160 and 410 of SEQ ID NO: 13 are in domain 1. Derivatization of such lysine residues to, for example, chemically conjugated antigens, may decrease TLR5 bioactivity and, thus, diminish an innate immune response mediated by TLR5.

Lysine residues that can be substituted can include lysine residues implicated in TLR5 activation. Lysine residues in motif N (amino acids 95-108 of SEQ ID NO: 13) and/or motif C (amino acids 441-449 of SEQ ID NO: 13) can be suitable for substitution. Substitution of certain lysine residue in the flagellin (e.g., lysine at amino acid position 19, 41) with, for example, an arginine, serine or histidine, can maintain binding of the flagellin to TLR5 and leave other lysines available for chemical conjugate to another molecule, such as an antigen (e.g., protein) or another molecule, such as another protein, peptide or polypeptide.

The X-ray crystal structure of the F41 fragment of flagellin from Salmonella typhimurium shows the domain structure of flagellin (Samatey, F. A., et al., Nature 410:321 (2001)). The full length flagellin protein contains 4 domains, designated as D0, D1, D2 and D3. Three of these domains are shown in the crystal structure because the structure was made with a proteolytic fragment of full length flagellin. The amino acid sequences of Salmonella typhimurium flagellin for these regions, numbered relative to SEQ ID NO: 13 are as follows:

D0 contains the regions A1 through A55 and 5451 through R494

D1 contains the regions N56 through Q176 and T402 through R450

D2 contains the regions K177 through G189 and A284 through A401

D3 contains the region Y190 though V283

Exemplary lysine residues of SEQ ID NO: 13 suitable for substitution with, for example, arginine, histidine, or serine, can include:

D0 contains 2 lysine residues; K19, K41

D1 contains 4 lysine residues; K58, K135, K160 and K410

D2 contains 14 lysine residues at positions 177, 179, 292, 308, 317, 326, 338, 348, 357, 362, 369, 378, 384, 391

D3 contains 8 lysine residues at positions 203, 215, 221, 228, 232, 241, 251, 279

Exemplary lysine residues suitable for substitution include lysines at positions 58, 135, 160 and 410 of SEQ ID NO: 13 (Jacchieri, S. G., et. al., *J. Bacteriol.* 185:4243 (2003); Donnelly, M. A., et al., *J. Biol. Chem.* 277:40456 (2002)). The sequences were obtained from the Swiss-Prot Protein Knowledgebase. Lysine residues that can be modified are indicated with a *.

Exemplary lysine residues of SEQ ID NO: 14 suitable for substitution can include:

D0—with two lysines at positions 20, 42;
D1—with five lysines at positions 59, 136, 161, 414, 422;
D2—with sixteen lysines at positions 177, 182, 189, 299, 319, 325, 328, 337, 341, 355, 357, 369, 381, 390, 396, 403 and
D3—with seven lysines at positions 209, 227, 234, 249, 271, 281, 288.

The antigen for use in the fusion proteins of the invention can be a protein antigen, such as at least one member selected from the group consisting of a bacterial protein antigen, a viral protein antigen, a parasitic protein antigen, a tumor protein antigen, a mycoplasma protein antigen and an allergen protein antigen. The viral protein antigen can be at least one member selected from the group consisting of an influenza viral protein antigen, a respiratory synctial viral protein antigen and a flavivirus protein antigen. The parasite protein antigen can be a malaria parasite protein antigen.

The antigen can be a non-protein antigen, such as at least one member selected from the group consisting of a polysaccharide antigen, a lipid antigen, a nucleic acid antigen and a lipopolysaccharide antigen. The polysaccharide antigen can include a tumor polysaccharide antigen.

Serotype 14 capsular polysaccharide from *Streptococcus pneumoniae* (PS14) can be activated by 1-cyano-4-dimethylaminopyridinium tetrafluoroborate (CDAP) in the presence triethylamine, and subsequently derivatized by hexanediamine to convert free hydroxyls to free amino groups. The free amino groups can be subsequently reacted with N-hydroxysuccinimidyl bromoacetate. A flagellin construct containing a cysteine residue with a free sulfhydryl can be reacted with the activated polysaccharide to form a covalent thioether (Lees, A., et al., *Vaccine* 14:190 (1996)). The degree of activation of the polysaccharide can be controlled to vary the density of conjugated flagellin to the polysaccharide. Other serotypes of capsular polysaccharides can be conjugated to flagellin by a similar method. The repeating unit structure of a polysaccharide from *Streptococcus pneumoniae* serotype 14 (PS14) is →4)-β-D-Glcp-(1→6)-[β-D-Galp-(1→4)]-β-D-GlcpNAc-(1→3)-β-D-Galp-(1→(Lindberg, B., et al., *Carbohydr Res* 58: 177-186 (1977)).

Compositions and fusion proteins of the invention can be associated with a particle, such as at least one member selected from the group consisting of a nanoparticle, liposome, a viral particle, a fungal particle, a derivatized polysaccharide and a derivatized protein. Compositions and fusion proteins of the invention can be administered to a subject in at least one dose selected from the group consisting of at least one dose selected from the group consisting of about a 10.0 µg dose, about a 5.0 µg dose, about a 3.0 µg dose, about a 2.5 µg dose, about a 1.0 µg dose, about a 0.5 µg dose, about a 0.3 µg dose, about a 0.25 µg dose, about a 0.1 µg dose, about a 0.05 µg dose, about a 0.025 µg dose and about a 0.01 µg dose.

The compositions and fusion proteins of the invention can be administered to a subject, such as a human, in a single dose or in multiple doses (e.g., two doses, three doses, four doses). When the compositions and fusion proteins of the invention are administered in two or more doses a second or more dose of the composition or fusion protein can be administered about 28 days following administration of a first dose.

In another embodiment, the invention is a method of making a Toll-like Receptor 5 agonist, comprising the steps of separating a portion of a protein from a naturally occurring flagellin to thereby form a protein portion, wherein the protein portion includes, in sequence, an amino-domain 0, an amino-domain 1, an amino-domain 2, a carboxy-domain 2, a carboxy-domain 1 and a carboxy-domain 0 (R3, D3, R3-2xAg); transforming a nucleic acid sequence encoding the protein portion into a host cell; and culturing the host cell to thereby make the Toll-like Receptor 5 agonist. An exemplary Toll-like Receptor 5 agonist made by the method includes an R3 construct as set forth in SEQ ID NO: 29.

A protein domain is a part of a protein sequence and structure that can evolve, function, and exist independently of other portions of the protein. Each domain can form a three-dimensional structure and can be independently stable and folded. Many proteins consist of several structural domains. Generally, domains of proteins can vary in length from between about 25 amino acids up to 500 amino acids in length.

Figure 54:
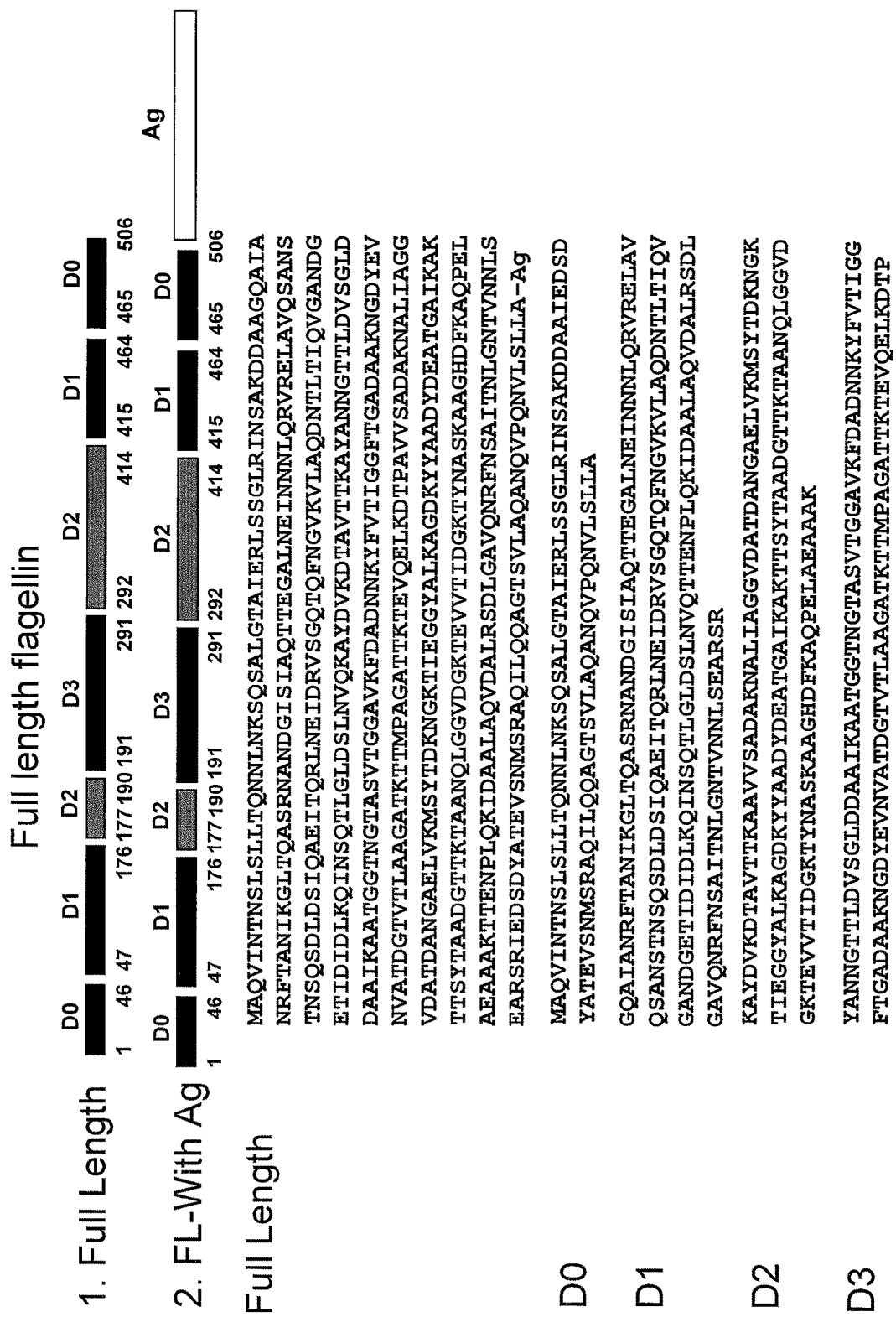
FIG. 54 depicts the domains (D0, D1, D2, D3) of full length flagellin (FL) and a fusion protein that includes Domains 0, 1, 2 and 3 and an antigen (Ag) fused to the carboxy-terminus of the flagellin (Yonekura, et al., Nature 424: 643-650 (2003)).

The high resolution atomic model of *Salmonella typhimurium* flagella has been derived from analyses of the crystal structure and electron cryomicroscopy (Yonekura et al., *Nature* 424(6949): 643-50 (2003)). *Salmonella typhimurium* flagellin (SEQ ID NO: 448) contains four domains, termed D0, D1, D2 and D3 as depicted in FIG. 54. Domain D0 (also referred to herein as "domain 0" or "D0") forms the inner core of the filament and domain D1 (also referred to herein as "domain 1" or "D1") forms the outer core of the filament. Domains D2 (also referred to herein as "domain 2" or "D2") and D3 (also referred to herein as "domain 3" or "D3") project outward on the flagellin filament surface to form the "turbo blade" (also referred to herein as "propellor") of the filament. The four domains, D0, D1, D2 and D3, are linearly connected from the inside to outside of the flagellin filament. The N-terminal chain of the flagellin monofilament begins at D0, progressing to D1 and D2 sequentially and folds within D3. The peptide chain of the flagellin monofilament then returns to D2 and D1, and eventually ends in a carboxy domain 0. Although connections between domains (D0 to D1, D1 and D2, D2 to D3) are formed by pairs of short anti-parallel chains, the one that connects domains D0 and D1 is longer compared to the other two, and can be referred to as the "spoke region."

The high resolution flagellin model demonstrates that domain D0 contains one pair of α-helices forming a two-stranded coiled-coil. Each strand derives from an N and a C terminus peptide. More specifically, the N-terminal peptide (1-33) (SEQ ID NO: 448) and the C-terminal peptide (461-495) (SEQ ID NO:448) contribute to the domain D0 two-stranded coiled-coil (SEQ ID NO: 448). In this structure (SEQ ID NO: 448) the N-terminal helix is about 33 amino acids long and C-terminal strand is about 35 amino acids.

When forming the inner tube of flagella, domain D0 of multiple flagellins pack against one another in a spiral. A pair of flexible linkers connects domains D0 and D1 (SEQ ID NO: 448). The N-terminus proximal linker (34-46, spoke region) (SEQ ID NO: 448) is comparatively longer, containing about 13 amino acids while C-terminus proximal linker (454-460) contains 7 amino acids (SEQ ID NO: 448). Multiple D1 domains also pack against each other when forming the polymeric flagella structure. Domain D1 is responsible for forming the outer tube of the flagella core. Domain D1 has mixed α and β elements and both structural elements are formed by the N and C termini proximal peptides (SEQ ID NO: 448). The N-terminus proximal peptide (47-176) (SEQ ID NO: 448) constitutes greater than about 70% of domain D1 and includes two α-helices and one two-stranded β-sheet. The C-terminus proximal peptide (404-453) (SEQ ID NO: 448) forms a single α-helix about 50 amino acids long of domain 1.

Three helices pack together to form the TLR5 binding site (Smith et al., *Nature Immunology;* 22:1247-1253 (2003)). Domains D2 and D3 protrude outwards from the flagellin core. Since this region is highly variable and it is located in the central region in the primary sequence, Domains D2 and D3 can be referred to as the "hypervariable region" or the "hinge region". Structurally, the majority of the hinge region is the β structure. Other than a short α-helix (about 10 amino acids), about 93% of domain D2 are β-sheets connected by loops and turns. The N-terminus proximal peptide (177-190) (SEQ ID NO: 448) contributes a single β-strand. The C-terminus proximal peptide (286-403) constitutes the majority (about 91%) of the domain D2 (SEQ ID NO: 448). Domain D3 resides on the tip of the "turbo blade." Similar to domain D2, D3 is formed by β elements. Eight β-strands form three sets of sheet in domain D3 (SEQ ID NO: 448).

As shown herein, the primary amino acid sequence of several flagellins have relatively conserved domain D0 and D1, and relatively variable domain D2 and D3. The high degree of homology of D0 and D1 among different flagellins may be due to their shared structural roles in forming the core of the flagella. The domains of different flagellins from various species may share the same structural elements as seen in high resolution model described above. More specifically, domain D0 should contain a pair of coiled-coil that ranges about 30 amino acids. Domain D1 contains mixed α-helices, β-sheets as α-helices and a two-stranded β-sheet formed by an N-terminal peptide and a long α-helix from C-terminal peptide. The TLR5 binding region comprises an N-terminal peptide, a C-terminal fragment and is concentrated on the D1 helical region. Domains D2 and D3 of polymerized flagellin form the blade on the flagella and are also the major targets for the host immune responses. The hyper-variability of these regions may be an escape mechanism the bacteria utilize to evade the host defense. Although domains D2 and D3 vary in primary sequences, the overall structural organization is believed to be similar for different flagellins. Flagellin from certain species may even lack part of or the entire hinge region that is formed by the D2 and D3 domains. The domain boundaries between domains D1 and D2 are well defined.

Only monomeric flagellin activates the host innate immune response through the host receptor TLR5. Flagella, which is the whip-like appendage of bacteria, is composed of polymeric flagellin, which does not bind nor activate TLR 5. As described above, the region of flagellin that physically interacts with TLR5 has been mapped to domain D1 (Smith et al., *Nature Immunology* 22: 1247-1253 (2003)). While no critical regions in the other domains, including the conserved D0 domain, have been shown to be involved with the TLR5 interaction, alterations within these domains may influence this interaction, which may modulate inflammatory and immune responses, as described herein. For example, an activity of a flagellin construct, as measured by an in vitro TLR5 signalling assay and an in vivo reactogenicity model, described herein, is associated with the presence of an intact domain D0.

Partial or full deletions of this domain greatly reduce TLR5 activity and could be used therefore to modulate TLR5 signalling, such that minimal TLR5 stimulation is provided. As described herein, either deletion of Domain D3 or replacement of Domain D3 with an antigen provides a reduction in the reactogenicity profile as measured by the in vivo reactogenicity model. Constructs having D3 deletions or replacements can be employed to generate compositions that include antigens combined or fused to the constructs, which, in turn, can be employed in compositions to stimulate an immune response in a subject, in particular, a protective immune response, that maximizes immunogenicity and minimizes reactogenicity.

Compositions employing the Toll-like Receptor 5 agonists described herein, such as the R3 constructs (also referred to herein as "R3 flagellin construct," for example, SEQ ID NOs: 452, 457, 464, 465, 470 and 500-502) or the R32x construct (also referred to herein as "R32x flagellin construct," for example, SEQ ID NOs: 455, 471 and 503-506) can be used in combination with antigens. Thus, compositions and fusion proteins of the invention can be useful in vaccine compositions. Vaccines based on these constructs, such as the R0 construct (e.g., SEQ ID NOs: 453, 474 and 515-518), may be utilized when the host has no pre-existing immunity to the vaccine linked antigen (e.g., immunologically naïve), such as pandemic influenza. Simultaneous deletion of domains D2 and D3 (e.g., SEQ ID NOs: 472 and 473) provides a significant reduction in the reactogenicity profile and a modest reduction in the immune response elicited. Vaccines based on these constructs would be moderately to robustly immunogenic, modestly reactogenic and would likely be utilized when the host has pre-existing immunity to the vaccine linked antigen, such as in the case of a seasonal influenza vaccine.

Multiple flagellin variants with deletions or replacements of Domains D0, D2 or D3 are described herein. Deletion variants are named with the letter D and the replacement variants are named with the letter R. For example, STF2.R3D0 represents a construct in which domain D3 of flagellin is replaced by an antigen and domain D0 is deleted. The atomic model used to define the domain boundary was *Salmonella typhimurium* flagellin (fliC, PDB: 1UCU) (SEQ ID NO: 448). For the design, the protein sequence of *Salmonella typhimurium* flijB was aligned with 1UCU sequence using CLUSTALW (Thompson, J. D., et al. *Nucleic Acids Research,* 22:4673-4680 (1994)). Experimental data presented herein demonstrate that these designs can be applied to a number of different vaccine antigens fused to the flijB flagellin (SEQ ID NO: 447). In the design of the fljB constructs, the domain boundaries of fliC (SEQ ID NO: 448) were mapped to flijB by alignment of the primary sequences. The designs of the different flagellin variants (also referred to herein as "forms of flagellin") can be based on domain boundaries which can be mapped, by alignment to multiple flagellins.

For example, another flagellin can be aligned with known domains of STF 2 to discern the corresponding domains, such as the amino-domain 0, the amino domain 1, the amino domain 2, domain 3, the carboxy domain 2, the carboxy domain 1 and the carboxy domain 0. Sequences sharing at least about 50% identity for the domains can be identified. The resulting flagellin constructs may possess TLR5 signaling and host reactogenicity properties that are similar the fljB constructs described herein.

Identification of the flagellin domain boundaries of common commensal bacterial *E. coli* flagellin is illustrated below (Accession number BAA85080). Table 1 shows the sequence alignment of fliC (SEQ ID NO: 448), fljB (SEQ ID NO: 447) and *E. coli* flagellin (SEQ ID NO:449) was performed using CLUSTAL W (*Pôle BioInformatique Lyonnais*). Domain components of *S. typhorium* fliC (SEQ ID NO: 448), determined by high resolution model, are marked by alternating boxes. Domain components are labeled on the top of the respective component, such as D0N, D1N, D2N, D3, D2C, D1C and D0C. The same components were then mapped to *S. typhorium* fljB (SEQ ID NO: 447) and *E. coli* flagellin (SEQ ID NO: 449) according to alignment. Therefore, D0N of fljB (SEQ ID NO: 447) was determined to range from amino acid 1-46 and for *E. coli* flagellin (SEQ ID NO: 449) it ranged from 1-46. The spoke region for both ranged from 34-46. DIN of fljB (SEQ ID NO: 447) ranged from 47-176 and that of *E. coli* ranged from 47-176 (SEQ ID NO: 449). D2N ranged from 177-190 for fljB (SEQ ID NO: 447) and 177-190 for *E. coli* (SEQ ID NO: 449). D3 ranged from 191-291 for fljB (SEQ ID NO: 447) and 191-343 for *E. coli* (SEQ ID NO:449). D2C ranged from 292-414 for fljB (SEQ ID NO: 447) and 344-502 for *E. coli* (SEQ ID NO: 449). D1C ranged from 415-464 for fljB (SEQ ID NO:447) and 503-552 for *E. coli* (SEQ ID NO: 449), and D0C ranged from 465-506 for fljB (SEQ ID NO: 447) and 553-595 for *E. coli* (SEQ ID NO: 449).

TABLE 1

Exemplary Flagellin Domain Boundaries (D0N, D1N, D2N, D3, D2C, D1C and D0C) are depicted as follows:

```
                         10        20        30        40        50
                         |         |         |         |         |
                              D0N                              D1N
P06179_fliC     MAQVINTNSLSLLTQNNLNKSQSALGTAIERLSSGLRINSAKDDAAGQAI P52616_fljB     MAQVINTNSLSLLTQNNLNKSQSALGTAIERLSSGLRINSAKDDAAGQAI BAA85080_Ecoli  MAQVINTNSLSLITQNNINKNQSALSSSIERLSSGLRINSAKDDAAGQAI
                **********::.**.::.*******************

60        70        80        90       100
                         |         |         |         |         |
                                           D1N
P06179_fliC     ANRFTANIKGLTQASRNANDGISIAQTTEGALNEINNNLQRVRELAVQSA P52616_fljB     ANRFTANIKGLTQASRNANDGISIAQTTEGALNEINNNLQRVRELAVQSA BAA85080_Ecoli  ANRFTSNIKGLTQAARNANDGISVAQTTEGALSEINNNLQRIRELTVQAS
                ***:***:*****:****.****:*.**::

110       120       130       140       150
                         |         |         |         |         |
                                           D1N
P06179_fliC     NSTNSQSDLDSIQAEITQRLNEIDRVSGQTQFNGVKVLAQDNTLTIQVGA P52616_fljB     NSTNSQSDLDSIQAEITQRLNEIDRVSGQTQFNGVKVLAQDNTLTIQVGA BAA85080_Ecoli  TGTNSDSDLDSIQDEIKSRLDEIDRVSGQTQFNGVNVLAKDGSMKIQVGA
                ..*:***..:***********:*:*.:.:*****

160       170       180       190       200
                         |         |         |         |         |
                              D1N                D2N         D3
P06179_fliC     NDGETIDIDLKQINSQTLGLDTLNVQQKYKVSDTAATVTGYADT------

P52616_fljB     NDGETIDIDLKQINSQTLGLDSLNVQKAYDVKDTAVTTKAYANNGTTLD-

BAA85080_Ecoli  NDGQTITIDLKKIDSDTLGLNGFNVNGSGTIANKAATISDLTAAKMDAAT
                ***:**.****:*.*:****:..**:     ::.*.*  .   :

210       220       230       240       250
                         |         |         |         |         |
                                            D3
P06179_fliC     ------------------TIALDNSTFKASATGLG--GTDQKIDGDLKFD P52616_fljB     ------------------VSGLDDAAIKAATGGTN--GTASVTGGAVKFD BAA85080_Ecoli  NTITTTNNALTASKALDQLKDGDTVTIKADAAQTATVYTYNASAGNFSFS
                                   *    ::**   :        *  .   *  ...*.

260       270       280       290       300
                         |         |         |         |         |
                                            D3
P06179_fliC     DTTGKYYAKVT------------VTGG-TGKDGYYEVSVDKTNGEVTLA P52616_fljB     ADNNKYFVTIGG-----------FTGADAAKNGDYEVNVA-TDGTVTLA BAA85080_Ecoli  NVSNNTSAKAGDVAASLLPPAGQTASGVYKAASGEVNFDVD-ANGKITIG
                 ..:    ..                :*     . .*    :..*    ::.*.**:.
```

TABLE 1-continued

Exemplary Flagellin Domain Boundaries (D0N, D1N, D2N, D3, D2C, D1C and D0C) are depicted as follows:

```
                310       320       330       340       350
                 |         |         |         |         |
                                    D3                  D2C
P06179_fliC     G----------------GATSPLTGGLPATATEDVKN--VQVA NADL--

P52616_fljB     A----------------GATKTTMPAGATTKTEVQEL--KDTP AVVS--

BAA85080_Ecoli  GQEAYLTSDGNLTTNDAGGATAATLDGLFKKAGDGQSIGFNKTA SVTMGG
                                 ***    .       :       ....
                360       370       380       390       400
                 |         |         |         |         |
                                    D2C
P06179_fliC     --------TEAKAALTAAGVTGTAS-----VVKMSYTDNNGKTIDGG---

P52616_fljB     --------ADAKNALIAGGVDATDANGAE-LVKMSYTDKNGKTIEGG---

BAA85080_Ecoli  TTYNFKTGADAGAATANAGVSFTDTASKETVLNKVATAKQGTAVAANGDT
                  :.*   .**   *  :        :::    * *:*.::  ..
                410       420       430       440       450
                 |         |         |         |         |
                                    D2C
P06179_fliC     --------------LAVKVGDDYYSATQNKD-GSISINTTKYTADDGTSK P52616_fljB     --------------YALKAGDKYYAADYDEATGAIKAKTTSYTAADGTTK BAA85080_Ecoli  SATITYKSGVQTYQAVFAAGDTASAKYADN-TDVSNATATYTDADGEMT
                          ...**   :*   .     :.   *:.    .
                460       470       480       490       500
                 |         |         |         |         |
                                    D2C
P06179_fliC     TALN-----KLGGADGKTEVVSIGGKTYAASKAEGHNFKAQP----DLAE P52616_fljB     TAAN-----QLGGVDGKYEVVTIDGKTYNASKAAGHDFKAQP----ELAE BAA85080_Ecoli  TIGSYTTKYSIDANNGKVTVDSGTGTGKYAPKVGAEVYVSANGTLTTDAT
                *  .    .:.. :**.* :  *.  *.  *.* .. : :         *
                510       520       530       540       550
                 |         |         |         |         |
                 D2C                           D1C
P06179_fliC     AAAT TTENPLQKIDAALAQVDTLRSDLGAVQNRFNSAITNLGNTVNNLTS P52616_fljB     AAAK TTENPLQKIDAALAQVDALRSDLGAVQNRFNSAITNLGNTVNNLSE BAA85080_Ecoli  SEGT VTKDPLKALDEAISSIDKFRSSLGAIQNRLDSAVTNLNNTTTNLSE
                :  ...*::**: :* *:::.* :.*:***:..* *. ..**:.
                560       570       580       590
                 |         |         |         |
                 D1C                 D0C
P06179_fliC     ARSR IEDSDYATEVSNMSRAQILQQAGTSVLAQANQVPQNVLSLLR- (SEQ ID NO: 448)

P52616_fljB     ARSR IEDSDYATEVSNMSRAQILQQAGTSVLAQANQVPQNVLSLLR- (SEQ ID NO: 447)

BAA85080_Ecoli  AQSR IQDADYATEVSNMSKAQIIQQAGNSVLAKANQVPQQVLSLLQG (SEQ ID NO: 448)
                *:***.*:**********:***:****.****:******:*****:
```

Alignment data:
Alignment length: 597
Identity (*): 239 is 40.03%
Strongly similar (:): 78 is 13.07%
Weakly similar (.): 65 is 10.89%
Different: 215 is 36.01%
Sequence 0001: P06179_fliC (495 residues).
Sequence 0002: P52616_fljB (506 residues).
Sequence 0003: BAA85080_Ecoli (595 residues).

The domain boundaries of flagellin from *Bacillus subtilis* (SEQ ID NO: 450), are shown in Table 2. The *Bacillus subtilis* flagellin (SEQ ID NO: 450) has a substantial deletion in the hinge region while domain D0 and D1 are about 65% similar to *S. typhorium*. D0N of *Bacillus subtilis* flagellin is amino acid residues 1-44 (SEQ ID NO: 4), D1N is amino acid residues 45-170 (SEQ ID NO: 450), D2N is amino acid residues 171-177 (SEQ ID NO: 450), D3 is amino acid residues 178-191 (SEQ ID NO: 450), D2C is amino acid residues 192-235 (SEQ ID NO: 450), D1C is amino acid residues 236-286 (SEQ ID NO: 450) and D0C is amino acid residues 286-317 (SEQ ID NO: 450). As illustrated in Table 2, *Bacillus subtilis* flagellin has a relatively small D2N (7 amino acids) (SEQ ID NO: 450) and D3 domain (14 amino acids) (SEQ ID NO: 450). The D3 domain is missing and is substituted by a simple loop or a small secondary structure element. However, D0, D1 and majority of D2 are still identifiable. Table 3 summarizes the findings of the different alignments shown in Tables 1 and 2.

TABLE 2

Exemplary Flagellin Domain Boundaries

```
                          10        20        30        40        50
                          |         |         |         |         |
                          D0N                                     D1N
P06179_fliC     MAQVINTNSLSLLTQNNLNKSQSALGTAIERLSSGLRINSAKDDAAGQAI P52616_fljB     MAQVINTNSLSLLTQNNLNKSQSALGTAIERLSSGLRINSAKDDAAGQAI ABN13608_Bsub   --MRINHNIAALNTSRQLNAGSDSAAKNMEKLSSGLRINRAGDDAAGLAI
                  * *   :*  *..:**  ...:  .. :*:******* * ***

60        70        80        90       100
                          |         |         |         |         |
                                                        D1N
P06179_fliC     ANRFTANIKGLTQASRNANDGISIAQTTEGALNEINNNLQRVRELAVQSA P52616_fljB     ANRFTANIKGLTQASRNANDGISIAQTTEGALNEINNNLQRVRELAVQSA ABN13608_Bsub   SEKMRSQIRGLDMASKNAQDGISLIQTSEGALNETHSILQRMSELATQAA
                :::: ::*:  ::: :**** :. *: ***.*:*

110       120       130       140       150
                          |         |         |         |         |
                                              D1N
P06179_fliC     NSTNSQSDLDSIQAEITQRLNEIDRVSGQTQFNGNKVLA-QDNTLTIQVG P52616_fljB     NSTNSQSDLDSIQAEITQRLNEIDRVSGQTQFNGNKVLA-QDNTLTIQVG ABN13608_Bsub   NDTNTDSDRSELQKEMDQLASEVTRISTDTEFNTKKLLDGTAQNLTFQIG
                *.::  ...:* *: *  .*: *:* :*:**  *:*   :.**:*

160       170       180       190       200
                          |         |         |         |         |
                          D1N                 D2N        D3
P06179_fliC     ANDGETIDIDLKQINSQTLGLDTLNVQQKYKVSDTAATVTGYADT-----

P52616_fljB     ANDGETIDIDLKQINSQTLGLDSLNVQKAYDVKDTAVTTKAYANNGTTLD

ABN13608_Bsub   ANEGQTMSLSINKMDSE-----SLKVGTTYTVSG-------DQNT-----
                **:*:*:.:.:::::*:      :*:*  *  ..         :.

210       220       230       240       250
                          |         |         |         |         |
                                              D3
P06179_fliC     TIALDNSTFKASATGLGGTDQKIDGDLKFDDTTGKYYAKVT-VTGG-TGK P52616_fljB     VSGLDDAAIKAATGGTNGTASVTGGAVKFDADNNKYFVTIGGFTGADAAK ABN13608_Bsub   ----------------LTATDG----------------------------
                                .*

260       270       280       290       300
                          |         |         |         |         |
                                              D3                  D2C
P06179_fliC     DGYYEVSVDKTNGEVTLAGGATSPLTGGLPATATEDVKNVQVANADLTEA P52616_fljB     NGDYEVNVA-TDGTVTLAAGATKTTMPAGATTKTEVQELKDTPAVVSADA ABN13608_Bsub   -----STAT-------------------------------------WADA
                        ..                                      : :*

310       320       330       340       350
                          |         |         |         |         |
                                              D2C
P06179_fliC     KAALTAAGVTGTAS----VVKMSYTDNNGKTIDGGLAVKVGDDYYSATQN P52616_fljB     KNALIAGGVDATDANGAELVKMSYTDKNGKTIEGGYALKAGDKYYAADYD ABN13608_Bsub   D--------DATNK-----PAGYYDAG-GKVIAS----------------
                .        .*        *   **.*  .
```

TABLE 2-continued

Exemplary Flagellin Domain Boundaries

```
              360       370       380       390       400
               |         |         |         |         |
                                  D2C
P06179_fliC   KD-GSISINTTKYTADDGTSKTALNKLGGADGKTEVVSIGGKTYAASKAE P52616_fljB   EATGAIKAKTTSYTAADGTTKTAANQLGGVDGKTEVVTIDGKTYNASKAA ABN13608_Bsub -E-------K--LAADSKVTK-------GID------------------
                  .:*  . .:*    * *
              410       420       430       440       450
               |         |         |         |         |
                  D2C                 D1C
P06179_fliC   GHNFKAQPDLAEAAATTTENPLQKIDAALAQVDTLRSDLGAVQNRFNSAI P52616_fljB   GHDFKAQPELAEAAAKTTENPLQKIDAALAQVDALRSDLGAVQNRFNSAI ABN13608_Bsub ----------ISSSAKAASSALTTIKTAIDTVSSERAKLGAVQNRLEHTI
                        .::*.::...* .*.:*:  *.: *:.*******:: :*
              460       470       480       490       500
               |         |         |         |         |
                  D1C                 D0C
P06179_fliC   TNLGNTVNNLTSARSRIEDSDYATEVSNMSRAQILQQAGTSVLAQANQVP P52616_fljB   TNLGNTVNNLSEARSRIEDSDYATEVSNMSRAQILQQAGTSVLAQANQVP ABN13608_Bsub NNLGTSSENLTSAESRIRDVDMASEMMEYTKNNILTQASQAMLAQANQ--
              .*.: ::.*.***.*  *  *:*:  :  :: : . ::******
                  D0C
P06179_fliC   QNVLSLLR (SEQ ID NO: 448)

P52616_fljB   QNVLSLLR (SEQ ID NO: 447)

ABN13608_Bsub -------- (SEQ ID NO: 450)
```

Alignment data:
Alignment length: 508
Identity (*): 128 is 25.20%
Strongly similar (:): 70 is 13.78%
Weakly similar (.): 44 is 8.66%
Different: 266 is 52.36%
Sequence 0001: P06179_fliC (495 residues).
Sequence 0002: P52616_fljB (506 residues).
Sequence 0003: ABN13608_Bsub (317 residues).

TABLE 3

Exemplary Domains of Flagellins

| Flagellin | Sequence Accession Number | SEQ ID Number | Domain Boundary | | | | | | |
|---|---|---|---|---|---|---|---|---|---|
| | | | D0N | D1N | D2N | D3 | D2C | D1C | D0C |
| S. typhimurium fliC | P06179 | 448 | 1-46 | 47-176 | 177-190 | 191-285 | 286-403 | 404-453 | 454-460 |
| S. typhimurium flijB | P52616 | 447 | 1-46 | 47-176 | 177-190 | 191-291 | 292-414 | 415-464 | 465-506 |
| E. coli | BAA85080 | 449 | 1-46 | 47-176 | 177-190 | 191-343 | 344-502 | 503-552 | 553-595 |
| B. subtilis | ABN13608 | 450 | 1-44 | 45-177 | 171-177 | 178-191 | 192-235 | 236-286 | 286-317 |

The host cell employed in the methods described herein can be a prokaryotic host cell or a eukaryotic host cell. The prokaryotic host cell can be at least one member selected from the group consisting of an *E. coli* prokaryotic host cell, a *Pseudomonas* prokaryotic host cell, a *Bacillus* prokaryotic host cell, a *Salmonella* prokaryotic host cell and a *P. fluorescens* prokaryotic host cell.

The eukaryotic host cells employed in the methods of the invention can include a *Saccharomyces* eukaryotic host cell, an insect eukaryotic host cell (e.g., at least one member selected from the group consisting of a *Baculovirus* infected insect cell, such as *Spodoptera frugiperda* (Sf9) or *Trichhoplusia ni* (High5) cells; and a *Drosophila* insect cell, such as Dme12 cells), a fungal eukaryotic host cell, a parasite eukaryotic host cell (e.g., a *Leishmania tarentolae* eukaryotic host cell), CHO cells, yeast cells (e.g., *Pichia*) and a *Kluyveromyces lactis* host cell.

Suitable eukaryotic host cells and vectors can also include plant cells (e.g., tomato; chloroplast; mono- and dicotyledonous plant cells; *Arabidopsis thaliana; Hordeum vulgare; Zea mays*; potato, such as *Solanum tuberosum*; carrot, such as *Daucus carota* L.; and tobacco, such as *Nicotiana tabacum, Nicotiana benthamiana* (Gils, M., et al., *Plant Biotechnol J.* 3:613-20 (2005); He, D. M., et al., *Colloids Surf B Biointerfaces*, (2006); Huang, Z., et al., *Vaccine* 19:2163-71 (2001); Khandelwal, A., et al., *Virology.* 308:207-15 (2003); Marquet-Blouin, E., et al., *Plant Mol Biol* 51:459-69 (2003); Sudarshana, M. R., et al. *Plant Biotechnol J.* 4:551-9 (2006); Varsani, A., et al., *Virus Res,* 120:91-6 (2006); Kamarajugadda S., et al., *Expert Rev Vaccines* 5:839-49 (2006); Koya V, et al., *Infect Immun.* 73:8266-74 (2005); Zhang, X., et al., *Plant Biotechnol J.* 4:419-32 (2006)).

In another embodiment, the proteins of the invention are made in cell-free systems.

The proteins made by the methods of the invention and the compositions of the invention can be purified and characterized employing well-known methods (e.g., gel chromatography, ion exchange chromatography, SDS-PAGE), as described herein.

The method of making the Toll-like Receptor 5 that includes the protein portion, in sequence, an amino-domain 0, an amino-domain 1, an amino-domain 2, a carboxy-domain 2, a carboxy-domain 1 and a carboxy-domain 0 (an R3 construct) can further include the step of operably linking a second nucleic acid sequence encoding at least one antigen to the nucleic acid sequence encoding the protein portion (such as SEQ ID NOs: 29, 699-701) to thereby make a fusion protein that activates a Toll-like Receptor 5. The second nucleic acid sequence can be linked to the 3' end of the nucleic acid sequence encoding the protein portion (an D3 construct). The method can further include the step of operably linking a second nucleic acid sequence encoding at least one antigen between the nucleic acid sequence encoding the amino-domain 2 and the nucleic acid sequence encoding the carboxy-domain 2 of the nucleic acid sequence encoding the protein portion (an R3 construct) to thereby make a fusion protein that activates a Toll-like Receptor 5, such as SEQ ID NOs: 452, 457, 464, 465, 470 and 500-502.

The method of making the Toll-like Receptor 5 that includes the protein portion, in sequence, an amino-domain 0, an amino-domain 1, an amino-domain 2, a carboxy-domain 2, a carboxy-domain 1 and a carboxy-domain 0 (an R3 construct) can further include the step of operably linking a second nucleic acid sequence encoding at least one antigen between the amino-domain 2 and the carboxy-domain 2 of the nucleic acid encoding the protein portion to thereby form a second protein portion; and operably linking a third nucleic acid sequence encoding at least one additional antigen to the 3' end of the nucleic acid sequence encoding the second protein portion (an R3-2xAg construct) to thereby make a fusion protein that activates a Toll-like Receptor 5, such as SEQ ID NOs: 455, 471 and 503-506. In an embodiment, the additional antigen encoded by the third nucleic acid sequence is similar to the antigen encoded by the second nucleic acid sequence. In another embodiment, the additional antigen encoded by the third nucleic acid sequence is distinct from the antigen encoded by the second nucleic acid sequence.

The nucleic acid encoding an antigen employed in the methods described herein can encode at least a portion of a viral antigen, such as an influenza viral antigen (e.g., HA, M2), an RSV antigen (e.g., RSVG, RSVF and RSVM2), an HPV antigen (e.g., E1, E2, E4, E6, E7, E6E7, L1 and L2) and a flavivirus antigen (e.g., Dengue flavivirus, West Nile flavivirus, Tick-borne encephalitis, Japanese encephalitis, Langat flavivirus, Kunjin flavivirus, Murray Valley flavivirus and Hepatitis C flavivirus) as described herein. Exemplary HA antigens, can include, SEQ ID NOs: 228-281, 283-295, 456, 481, 499, 662 and 665. An exemplary portion of a M2 protein can include the ectodomain of M2 (also referred to herein as "M2e"), such as SEQ ID NOs: 298, 300-321, 323-336, 485, 507 and 666. Exemplary RSV antigens include SEQ ID NOs: 519, 522, 524, 526-544, 546-551, 577-580, 582, 586, 611, 612, 617, 627, 694 and 840-843. Exemplary HPV antigens include SEQ ID NOs: 50-52, 54, 56, 58, 60, 62, 64, 66, 67, 69, 71, 73, 75, 76, 78, 80, 81, 83, 85, 87, 89, 90, 92, 94, 96, 98, 100-102, 104, 106-113, 122-144 and 193-197 and 680. Exemplary Dengue viral antigens include SEQ ID NOs: 339, 343, 345, 347, 351-355, 371, 381-384, 387-390, 636, 638, 640, 642, 644, 646, 648, 650, 652, 654, 656 and 658. Exemplary West Nile viral antigens include SEQ ID NOs: 341, 356, 358-361, 379, 443 and 444. Exemplary additional flavivirus antigens include SEQ ID NOs: 337, 349, 362-370, 372, 373, 375, 377, 380, 385, 386, 391-442 and 445. Exemplary amino acid sequences and nucleic acid sequences encoding Toll-like Receptor agonists, antigens and fusion proteins of the invention are described and provided in the Sequence Listing.

In another embodiment, the invention is a method of making a Toll-like Receptor 5 agonist, comprising the steps of separating a portion of a protein from a naturally occurring flagellin to thereby form a protein portion, wherein the protein portion includes, in sequence, an amino-domain 1, an amino-domain 2, a carboxy-domain 2 and a carboxy-domain 1 (an R3D0 construct, an R03 construct); transforming a nucleic acid sequence encoding the protein portion into a host cell; and culturing the host cell to thereby make the Toll-like Receptor 5 agonist. An exemplary Toll-like Receptor 5 agonist made by the method includes SEQ ID NOs: 30 and 814-816.

The method of making a Toll-like Receptor 5 agonist that includes a protein portion includes, in sequence, an amino-domain 1, an amino-domain 2, a carboxy-domain 2 and a carboxy-domain 1 can further include the step of operably linking a second nucleic acid sequence encoding at least one antigen between the nucleic acid sequence encoding the amino-domain 2 and the nucleic acid sequence encoding the carboxy-domain 2 of the nucleic acid encoding the protein portion (an R3D0 construct) to thereby form a fusion protein that activates a Toll-like Receptor 5, such as SEQ ID NOs: 800-803. The method can further include the step of operably linking a third nucleic acid sequence encoding at least one additional antigen to the 3' end of the nucleic acid sequence encoding the protein portion (an R03 construct), to thereby make a fusion protein that activates a Toll-like Receptor 5, such as SEQ ID NOs: 804-807. In an embodiment, the additional antigen encoded by the third nucleic acid sequence is similar to the antigen encoded by the second nucleic acid sequence. In another embodiment, the additional antigen encoded by the third nucleic acid sequence is distinct from the antigen encoded by the second nucleic acid sequence.

In yet another embodiment, the invention is a method of making a Toll-like Receptor 5 agonist, comprising the steps of separating a portion of a protein from a naturally occurring flagellin to thereby form a protein portion, wherein the protein portion includes, in sequence, an amino-domain 1, an amino-domain 2, a carboxy-domain 2, a carboxy-domain 1 and a carboxy-domain 0 (an D3N construct); transforming a nucleic acid sequence encoding the protein portion into a host cell; and culturing the host cell to thereby make the Toll-like Receptor 5 agonist. Exemplary Toll-like Receptor 5 agonists made by the method include SEQ ID NOs: 31 and 817-819. The method can further include the step of operably linking a second nucleic acid sequence encoding at least one antigen to the nucleic acid sequence encoding the protein portion, to thereby fuse the Toll-like Receptor 5 agonist to an antigen to make a fusion protein, such as SEQ ID NOs: 741, 747, 755, 808 and 809.

In a further embodiment, the invention is a method of making a Toll-like Receptor 5 agonist, comprising the steps of separating a portion of a protein from a naturally occurring flagellin to thereby form a protein portion, wherein the protein portion includes, in sequence, an amino-domain 1, an amino-domain 2, a carboxy-domain 2, a carboxy-domain 1, and wherein the protein portion lacks a portion of a carboxy-domain 0; transforming a nucleic acid sequence encoding the protein portion into a host cell; and culturing the host cell to thereby make the Toll-like Receptor 5 agonist. In an embodiment, the portion of the carboxy-domain 0 that is lacking from the protein portion is VPNVLSLLA (SEQ ID NO: 693). Exemplary Toll-like Receptor 5 agonist made by the method include SEQ ID NO: 32 and 820-822.

The method of making a Toll-like Receptor 5 agonist having a protein portion includes, in sequence, an amino-domain 1, an amino-domain 2, a carboxy-domain 2, a carboxy-domain 1, and wherein the protein portion lacks a portion of a carboxy-domain can further include the step of operably linking a second nucleic acid sequence encoding at least one antigen to the nucleic acid sequence encoding the protein portion to thereby make a fusion protein that activates a Toll-like Receptor 5.

In still another embodiment, the invention is a method of making a Toll-like Receptor 5 agonist, comprising the steps of separating a portion of a protein from a naturally occurring flagellin to thereby form a protein portion, wherein the protein portion includes, in sequence, an amino-domain 1 and a carboxy-domain 1 (an D1 construct); transforming a nucleic acid sequence encoding the protein portion into a host cell; and culturing the host cell to thereby make the Toll-like Receptor 5 agonist. Exemplary Toll-like Receptor 5 agonist made by the method include SEQ ID NO: 33 and 823-825. The method can further include the step of operably linking a second nucleic acid sequence encoding at least one antigen to the nucleic acid sequence encoding the protein portion. The methods of making Toll-like Receptor 5 agonists of the invention can include separating a portion of a protein from a naturally occurring flagellin to thereby form a protein portion, wherein the protein portion consists, in sequence, of particular domains of the naturally occurring flagellins, such as an R0 construct, an R3 construct, an R3D0 construct, an D3N construct, a D3NCs construct and a D1 construct.

In still another embodiment, the invention is a composition comprising at least one particle that includes at least a portion of at least one Toll-like Receptor agonist and at least a portion of at least one antigen, wherein the Toll-like Receptor agonist and the antigen are associated with the particle and a molar ratio of the Toll-like Receptor agonist to the antigen is no greater than about 1. In an embodiment, the particle is not an alum particle, is not an adenovirus, is not a poxvirus, is not an alphavirus, is not a nucleic acid and is not a plasmid DNA.

In still another embodiment, the invention is a composition comprising at least one nanoparticle that includes at least a portion of at least one Toll-like Receptor agonist (e.g., a TLR 5 agonist, such as flagellin, STF 2 (SEQ ID NO: 12-14, 16-22, 447-450, 661 and 836), STF2Δ (SEQ ID NO: 34 and 487), an R0 construct, an R3 construct, an R3D0 construct, an D3N construct, a D3NCs construct and a D1 construct) and at least a portion of at least one antigen, wherein the Toll-like Receptor agonist and the antigen are associated with the nanoparticle and a molar ratio of the Toll-like Receptor agonist to the antigen is no greater than about 1, for example, a molar ratio is selected from the group consisting of about 0.5, about 0.1, about 0.05, about 0.01, about 0.005, about 0.001, about 0.0005, about 0.0001, about 0.00005 and about 0.00001.

The Toll-like Receptor agonist can be associated with an outer surface or the inner surface of the particle. The antigen can be associated with an inner surface or the inner surface of the particle. Fusion proteins of the invention can be associated with the outer surface or inner surface of the particle. One or more Toll-like Receptor agonists (e.g., TLR5, TLR7, TLR8) can be associated with one or more distinct or similar antigens (e.g., HA, M2e, RSV Fprotein, RSV Gprotein, HPV capsed protein, HPV tumor suppressor, binding protein).

In another embodiment, a fusion protein of the invention can be associated with a particle and a Toll-like Receptor agonist and/or antigen can also be associated with the particle. The Toll-like Receptor agonist can be similar to or distinct from the TLR agonist that is a component of the fusion protein. Likewise, the antigen can be similar to or distinct from the antigen that is a component of the fusion protein. For example, a fusion protein that includes an R3 construct and an HA antigen (e.g., STF2.HA1-2(SI)) and a M2e antigen (e.g., 4xM2e), which is not fused to a TLR agonist, can be associated with a particle.

The average diameter of the nanoparticle employed in the compositions of the invention can be at least one member selected from the group consisting of about 20 nanometers, about 25 nanometers, about 30 nanometers, about 40 nanometers, about 50 nanometers, about 75 nanometers, about 100 nanometers, about 125 nanometers, about 150 nanometers, about 175 nanometers and about 200 nanometers. In another embodiment, the average diameter of the particle is at least one member selected from the group consisting of between about 10 to about 200 nanometers, between about 0.5 to about 5 microns and between about 5 to about 10 microns. In another embodiment, the average diameter of the microparticle is selected from the group consisting of about 0.1 μm, about 0.2 μm, about 0.4 μm, about 0.5 μm, about 1 μm and about 2 μm.

Nanoparticles for use in the compositions of the invention can be made from lipids or other fatty acids (see, for example, U.S. Pat. Nos. 5,709,879; 6,342,226; 6,090,406; Lian, et al., *J. of Pharma. Sci.* 90:667-680 (2001) and van Slooten, et al., *Pharm Res.* 17:42-48 (2000)) and non-lipid compositions (see, for example, Kreuter, *J. Anat.* 189:503-505 (1996), the teachings of all of which are hereby incorporated by reference in their entirety). The compositions can be bilayer or multi-lamellar liposomes and phospholipid based. Polymerized nanoparticles, as described, for example, in U.S. Pat. No. 7,285,289, the teachings of which are incorporated by reference in their entirety.

Metallic oxide nanoparticles for use in the compositions of the invention can be chemically substituted with at least one reactive moiety capable of forming a thioether bond employing conventionally techniques as described herein and in U.S. Pat. No. 6,086,881, the teachings of which are hereby incorporated by reference in their entirety. The antigen described herein can be coupled in a single step onto the metallic oxide particles by the formation of at least one thioether bond or it may be synthesized or assembled stepwise onto the metallic oxide particles after the initial thioether bond formation. The chemical derivatization reagents for the metallic oxide particles can include organosilane reagents that provide thioalkane functionality or other groups that may readily be converted into thiols or thiol-reactive moieties. Organosilane reagents which may be utilized for this purpose may be, but are not limited to, 3-mercaptopropyltrimethoxysilane, 3-aminopropyltriethoxysilane, 3-iodopropyltrimethoxysilane, 2-chloroethyltrichlorosilane, 3-glycidoxypropyltrimethoxysilane, vinyltrichlorosilane and 3-acryloxypropyltrimethoxysilane. Moieties that include one or more disulfide components may also be joined to the metallic oxide particle surface and thereby provide the corresponding reactive moiety able to enter into and form a thioether bond and juncture. Exemplary nanoparticles for use in the compositions of the invention include at least one member selected from the group consisting of poly(d,l-lactide-co-glycolide, also referred to as "poly (lactic-co-glycolic acid) and bisacyloxypropylcysteine.

Nanoparticles for use in the compositions of the invention can be made of inorganic material. Nanoparticles for use in the compositions of the invention can be made of a polymer material, such as at least one member selected from the group consisting of polystyrene, brominated polystyrene, polyacrylic acid, polyacrylonitrile, polyamide, polyacrylamide, polyacrolein, polybutadiene, polycaprolactone, polycarbonate, polyester, polyethylene, polyethylene terephthalate, polydimethylsiloxane, polyisoprene, polyurethane, polyvinylacetate, polyvinylchloride, polyvinylpyridine, polyvinylbenzylchloride, polyvinyltoluene, polyvinylidene chloride, polydivinylbenzene, polymethylmethacrylate, polylactide, polyglycolide, poly(lactide-co-glycolide), polyanhydride, polyorthoester, polyphosphazene, polyphosophaze, a carbohydrate, carboxymethyl cellulose, hydroxyethyl cellulose, agar, gel, proteinaceous polymer, polypeptide, eukaryotic and prokaryotic cells, viruses, lipid, metal, resin, latex, rubber, silicone (e.g., polydimethyldiphenyl siloxane), glass, ceramic, charcoal, kaolinite and bentonite.

Particles, such as nanoparticles, that are associated with the TLR agonists and the antigens can be microscopically evaluated the interaction of the particle preparations with cells in vivo and evaluated in animals (e.g., rabbits and mice) for the induction of antibodies against the antigens, T-cell responses and induction of TLR mediated innate responses in vitro using well-established methods.

Compositions described herein can include associating fusion proteins that include the antigens on the surface of nanoparticle. The composition can then be evaluated in a dose response experiments to determine whether the multimerization of the vaccine on particles enhances the immunogenicity of the vaccine at lower doses.

More than one antigen (e.g., 2, 3, 4, 5, 6, 7, 8) can be placed on the surface of a particle to expose multiple antigens on the surface of particle, which may augment T and/or B cell potency.

Linkages (also referred to herein as "association") of antigens to particles in the compositions of the invention can be by covalent linkages, such as carboxy, amine and sulfhydryl groups. TLR agonist, such as at least a portion of a flagellin with polyglutaminic acid at its carboxy-terminal end and/or at least one cysteine residue may serve as the point of an oriented covalent linkage of the antigen to the particle. Noncovalent associations, such as ionic bonding, may also be employed to link the antigen to a particle in the compositions of the invention. For example, polyglutaminic acid could be added to at least a portion of a flagellin for use in ionic bonding.

Particles for use in the compositions described herein can have an average diameter between about 0.5 to about 5 microns and between about 5 to about 10 microns. The particle can be at least one member selected from the group consisting of a liposome, a polymer (e.g., dextran), a viral particle, a fungal particle (e.g., a fungal particle, such as a polysaccharide fungal particle), a derivatized polysaccharide, a derivatized protein, a microparticle (e.g., at least one member selected from the group consisting of a polystyrene microparticle and a polyvinyltoluene microparticle). The microparticle can be an average diameter of the microparticle is selected from the group consisting of about 0.1 µm, about 0.2 µm, about 0.4 µm, about 0.5 µm, about 1 µm and about 2 µm.

"Particle," as used herein, refers to an aggregation of sufficiently many atoms or molecules that can be assigned macroscopic properties such as volume and density. The particle can be a soluble particle or an insoluble particle. In a particular embodiment, the particle is soluble in an aqueous solution or biological fluid, such as blood or serum.

In an embodiment, the particle can be a polymer, such as a polymer that is soluble biological fluids (e.g., blood, serum, mucosa). The soluble polymer can be dextran. Toll-like Receptor agonists of the invention (e.g., TLR5 agonists, such as flagellin, STF2, STF2Δ, an R0 construct, an R2 construct, an R3D0 construct, an D3N construct, an D3NCs construct and an D1 construct, in combination with antigens can be coupled to, or associated with, to the soluble polymer. Fusion proteins of the invention can also be coupled with a soluble polymer. The compositions that include the soluble polymer, antigen and TLR5, including fusion proteins of the invention, can be administered to subjects to stimulate an immune response, in particular a protective immune response to the antigen component of the composition or the fusion protein. Techniques to couple soluble polymers to proteins are known to one of skill in the art and include covalently coupling (see, for example, Du, Jin, et al, *Applied Radiation and Isotopes* 53:443-448 (2000) and Elsner, H. I. et. al., *J. of Immunological Methods* 181:65-73 (1995)). TLR 5 agonists and antigens can be coupled to the soluble polymer in a molar ratio of TLR5 agonist to antigen that is no greater than about 1, as described herein.

In an embodiment, dextran can be employed as a soluble polymer to deliver varying ratios of covalently coupled antigen, such as HA, M2e, influenza cleavage fragment, RSV antigens, HPV antigens and flavivirus antigens and flagellin as a conjugated dextran macromolecule. Native dextran can be fractionated into low molecular weight dextran (about 30 to about 100 kDa), intermediate molecular weight dextran (about 100 to about 300 kDa), and high molecular weight dextran (greater than about 300 kDa). Sized fractions of dextran can be chosen to achieve final desired ratios of peptide to flagellin. Dextran polymers contain a single terminal aldehyde. This aldehyde can be activated by cyanoborohydride under alkaline conditions and reacted with a C-terminal cysteine containing recombinant flagellin, achieving a single molecule of flagellin covalently linked to a single molecule of dextran polymer. Subsequently the flagellin-conjugated dextran can reacted with varying concentrations of 2,2,2-trifluoroethanesulfonyl chloride (tresyl chloride) to activate free hydroxyl groups on the dextran polymer. Carboxy-terminal cysteine containing peptides can then be reacted with the dextran forming covalent conjugates of flagellin and antigens. The ratio of antigen to flagellin construct (as opposed to flagellin to antigen ratio) can be at least one member selected from the group consisting of about 3, about 10, about 30, about 40, about 50, about 100, about 250, about 500 and about 1000.

In an embodiment, the average diameter of the particle employed in the compositions can be at least one member selected from the group consisting of between about 10 to about 200 nanometers, between about 0.5 to about 5 microns and between about 5 to about 10 microns.

The particle can be at least one member selected from the group consisting of a liposome, a viral particle, a fungal particle, (e.g., a polysaccharide fungal protein) a derivatized polysaccharide and a derivatized protein.

"Derivatized," as used herein, in reference to a polysaccharide or protein, means that the polysaccharide or protein is related structurally to a polysaccharide or protein that has undergone a process of chemical conversion.

The particle can be a microparticle, such as at least one member selected from the group consisting of a polystyrene microparticle and a polyvinyltoluene microparticle. The average diameter of the microparticle is selected from the group consisting of about 0.1 µm, about 0.2 µm, about 0.4 µm, about 0.5 µm, about 1 µm and about 2 µm.

The Toll-like Receptor agonist associated with the particle, such as a nonoparticle, can be at least one member selected from the group consisting of a Toll-like Receptor 2 agonist, a Toll-like Receptor 4 agonist, a Toll-like Receptor 5 agonist, a Toll-like Receptor 7 agonist, a Toll-like Receptor 8 agonist and a Toll-like Receptor 9 agonist.

In a particular embodiment, the Toll-like Receptor agonist associated with the particle is at least a portion of at least one Toll-like Receptor 5 agonist, such as at least a portion of a flagellin (SEQ ID NOs: 22 and 28-34). The flagellin can include at least one member selected from the group consisting of *Salmonella typhimurium* flagellin, an *E. coli* flagellin, a *S. muenchen* flagellin, a *Yersinia* flagellin, a *P. aeruginosa* flagellin and a *L. monocytogenes* flagellin. Suitable flagellin for use in the compositions that employ particles include at least one member selected from the group consisting of a *Salmonella typhimurium* flagellin (e.g., SEQ ID NOs: 12-15, 22, 447-448, 661 and 863), an *E. coli* flagellin, a *S. muenchen* flagellin, a *Yersinia* flagellin, a *P. aeruginosa* flagellin and a *L. monocytogenes* flagellin.

"At least a portion," as used herein in reference to a flagellin (e.g., *S. typhimurium* fliC, *E. coli* fliC, *S. muenchen* fliC), refers to any part of the flagellin (e.g., domain 1, 2, 3) or the entirety of the flagellin that can initiate an intracellular signal transduction pathway for a Toll-like Receptor 5.

The flagellin for use in the compositions described herein, such as compositions that include particles (e.g., nanoparticles) can be a flagellin that lacks at least a portion of a hinge region (e.g., SEQ ID NOs: 34 and 487). Hinge regions are the hypervariable regions of a flagellin. Hinge regions of a flagellin include domain 2 and domain 3 of a flagellin and are also referred to herein as "propeller domain or region," "hypervariable domain or region" and "variable domain or region."

"Lack" of a hinge region of a flagellin, means that at least one amino acid or at least one nucleic acid codon encoding at least one amino acid that comprises the hinge region of a flagellin is absent in the flagellin. Examples of hinge regions include amino acids 176-415 of SEQ ID NO: 12, which are encoded by nucleic acids 528-1245 of SEQ ID NO: 23; amino acids 174-422 of SEQ ID NO: 20, which are encoded by nucleic acids 522-1266 of SEQ ID NO: 26; or amino acids 173-464 of SEQ ID NO: 16, which are encoded by nucleic acids 519-1392 of SEQ ID NO: 25. Thus, if amino acids 176-415 were absent from the flagellin of SEQ ID NO: 12, the flagellin would lack a hinge region. A flagellin lacking at least a portion of a hinge region is also referred to herein as a "truncated version" of a flagellin.

"At least a portion of a hinge region," as used herein, refers to any part of the hinge region of the flagellin, or the entirety of the hinge region. "At least a portion of a hinge region" is also referred to herein as a "fragment of a hinge region." At least a portion of the hinge region of fljB/STF2 can be, for example, amino acids 200-300 of SEQ ID NO: 12. Thus, if amino acids 200-300 were absent from SEQ ID NO: 12, the resulting amino acid sequence of STF2 would lack at least a portion of a hinge region.

Flagellin that lack the entire hinge region, domain 2 (amino-domain 2 and carboxy domain 2) and domain 3, are also referred to herein as "D2D3 constructs," "D2D3L constructs" or "D2D3L flagellin constructs." The "L" in D2D3 refers to a linker (e.g., an amino acid linker) fused to the last amino acid of DIN (i.e., "LD2D3") or fused to the first amino acid of the D1C (i.e., "D2D3L"). Exemplary D2D3L flagellin constructs fused to an HA antigen are shown below. The HA antigen is underlined and a linker in the fusion protein is double underlined:

```
STF2ΔfliC.HA1-2(SI)                    (SEQ ID NO: 511)
MAQVINTNSLSLLTQNNLNKSQSALGTAIERLSSGLRINSAKDDAAGQAIANRFTANI
KGLTQASRNANDGISIAQTTEGALNEINNNLQRVRELAVQSANSTNSQSDLDSIQAEI
TQRLNEIDRVSGQTQFNGVKVLAQDNTLTIQVGANDGETIDIDLKQINSQTLGLDTLN
VHGAPVDPASPWTTENPLQKIDAALAQVDTLRSDLGAVQNRFNSAITNLGNTVNNLTS
ARSRIEDSDYATEVSNMSRAQILQQAGTSVLAQANQVPQNVLSLLRKGIAPLQLGNCS
VAGWILGNPECELLISRESWSYIVEKPNPENGTCYPGHFADYEELREQLSSVSSFERF
EIFPKESSWPNHTTTGVSASCSHNGESSFYKNLLWLTGKNGLYPNLSKSYANNKEKEV
LVLWGVHHPPNIGDQRALYHKENAYVSVVSSHYSRKFTPEIAKRPKVRDQEGRINYYW
TLLEPGDTIIFEANGNLIAPRYAFALSRGFGSGIINS STF2ΔfljB.HA1-2(SI)                    (SEQ ID NO: 512)
MAQVINTNSLSLLTQNNLNKSQSALGTAIERLSSGLRINSAKDDAAGQAIANRFTANI
KGLTQASRNANDGISIAQTTEGALNEINNNLQRVRELAVQSANSTNSQSDLDSIQAEI
TQRLNEIDRVSGQTQFNGVKVLAQDNTLTIQVGANDGETIDIDLKQINSQTLGLDSLN
VHGAPVDPASPWTENPLQKIDAALAQVDALRSDLGAVQNRFNSAITNLGNTVNNLSEA
RSRIEDSDYATEVSNMSRAQILQQAGTSVLAQANQVPQNVLSLLRKGIAPLQLGNCSV
AGWILGNPECELLISRESWSYIVEKPNPENGTCYPGHFADYEELREQLSSVSSFERFE
IFPKESSWPNHTTTGVSASCSHNGESSFYKNLLWLTGKNGLYPNLSKSYANNKEKEVL
VLWGVHHPPNIGDQRALYHKENAYVSVVSSHYSRKFTPEIAKRPKVRDQEGRINYYWT
LLEPGDTIIFEANGNLIAPRYAFALSRGFGSGIINS E.coliΔHA1-2(SI)                       (SEQ ID NO: 513)
MAQVINTNSLSLITQNNINKNQSALSSSIERLSSGLRINSAKDDAAGQAIANRFTSNI
KGLTQAARNANDGISVAQTTEGALSEINNNLQRIRELTVQASTGTNSDSDLDSIQDEI
KSRLDEIDRVSGQTQFNGVNVLAKDGSMKIQVGANDGQTITIDLKKIDSDTLGLNGFN
VNHGAPVDPASPWVTKDPLKALDEAISSIDKFRSSLGAIQNRLDSAVTNLNNTTTNLS
EAQSRIQDADYATEVSNMSKAQIIQQAGNSVLAKANQVPQQVLSLLQGKGIAPLQLGN
CSVAGWILGNPECELLISRESWSYIVEKPNPENGTCYPGHFADYEELREQLSSVSSFE
RFEIFPKESSWPNHTTTGVSASCSHNGESSFYKNLLWLTGKNGLYPNLSKSYANNKEK
EVLVLWGVHHPPNIGDQRALYHKENAYVSVVSSHYSRKFTPEIAKRPKVRDQEGRINY
YWTLLEPGDTIIFEANGNLIAPRYAFALSRGFGSGIINS
```

-continued

```
Bacillus subtilisΔHA1-2(SI)          (SEQ ID NO: 514)
MRINHNIAALNTSRQLNAGSDSAAKNMEKLSSGLRINRAGDDAAGLAISEKMRSQIRG
LDMASKNAQDGISLIQTSEGALNETHSILQRMSELATQAANDTNTDSDRSELQKEMDQ
LASEVTRISTDTEFNTKKLLDGTAQNLTFQIGANEGQTMSLSINKMDSESLKVGHGAP
VDPASPWAASSALTTIKTAIDTVSSERAKLGAVQNRLEHTINNLGTSSENLTSAESRI
RDVDMASEMMEYTKNNILTQASQAMLAQANQKGIAPLQLGNCSVAGWILGNPECELLI
SRESWSYIVEKPNPENGTCYPGHFADYEELREQLSSVSSFERFEIFPKESSWPNHTTT
GVSASCSHNGESSFYKNLLWLTGKNGLYPNLSKSYANNKEKEVLVLWGVHHPPNIGDQ
RALYHKENAYVSVVSSHYSRKFTPEIAKRPKVRDQEGRINYYWTLLEPGDTIIFEANG
NLIAPRYAFALSRGFGSGIINS
```

```
         10        20        30        40        50
          |         |         |         |         |
MAQVINTNSLSLLTQNNLNKSQSALGTAIERLSSGLRINSAKDDAAGQAI
MAQVINTNSLSLLTQNNLNKSQSALGTAIERLSSGLRINSAKDDAAGQAI
MAQVINTNSLSLITQNNINKNQSALSSSIERLSSGLRINSAKDDAAGQAI
--MRINHNIAALNTSRQLNAGSDSAAKNMEKLSSGLRINRAGDDAAGLAI
  ** *  :* *..:.*   ...: .. :*:********  * ***** **

60        70        80        90       100
          |         |         |         |         |
ANRFTANIKGLTQASRNANDGISIAQTTEGALNEINNNLQRVRELAVQSA
ANRFTANIKGLTQASRNANDGISIAQTTEGALNEINNNLQRVRELAVQSA
ANRFTSNIKGLTQAARNANDGISVAQTTEGALSEINNNLQRIRELTVQAS
SEKMRSQIRGLDMASKNAQDGISLIQTSEGALNETHSILQRMSELATQAA
 ::::  ::*:**   *:.:**:****: **:****.* :. *** **:..*::

110       120       130       140       150
          |         |         |         |         |
NSTNSQSDLDSIQAEITQRLNEIDRVSGQTQFNGVKVLAQDNT-LTIQVG
NSTNSQSDLDSIQAEITQRLNEIDRVSGQTQFNGVKVLAQDNT-LTIQVG
TGTNSDSDLDSIQDEIKSRLDEIDRVSGQTQFNGVNVLAKDGS-MKIQVG
NDTNTDSDRSELQKEMDQLASEVTRISTDTEFNTKKLLDGTAQNLTFQIG
 ..**::**  ..:*  *:.    .*: *:* :*:** ::*      :.:*:*

160       170       180       190       200
          |         |         |         |         |
ANDGETIDIDLKQINSQTLGLDTLNV-HGAPVDPASPWTTENPLQKIDAA
ANDGETIDIDLKQINSQTLGLDSLNV-HGAPVDPASPWT-ENPLQKIDAA
ANDGQTITIDLKKIDSDTLGLNGFNVNHGAPVDPASPWVTKDPLKALDEA
ANEGQTMLSLINKMDSE-----SLKVGHGAPVDPASPWAASSALTTIKTA
**:*:*:  :.::::*:      ::* ********** . ...* :. *

210       220       230       240       250
          |         |         |         |         |
LAQVDTLRSDLGAVQNRFNSAITNLGNTVNNLTSARSRIEDSDYATEVSN
LAQVDALRSDLGAVQNRFNSAITNLGNTVNNLSEARSRIEDSDYATEVSN
ISSIDKFRSSLGAIQNRLDSAVTNLNNTTTNLSEAQSRIQDADYATEVSN
IDTVSSERAKLGAVQNRLEHTINNLGTSSENLTSAESRIRDVDMASEMME
:   :.  *:.***.***::  ::.**..:   **:.*.***.* * *:*: :

260       270       280       290       300
          |         |         |         |         |
MSRAQILQQAGTSVLAQANQVPQNVLSLLR-KGIAPLQLGNCSVAGWILG
MSRAQILQQAGTSVLAQANQVPQNVLSLLR-KGIAPLQLGNCSVAGWILG
MSKAQIIQQAGNSVLAKANQVPQQVLSLLQGKGIAPLQLGNCSVAGWILG
YTKNNILTQASQAMLAQANQ-----------KGIAPLQLGNCSVAGWILG
 ::  :*:  **. ::**:***                *******************

310       320       330       340       350
          |         |         |         |         |
NPECELLISRESWSYIVEKPNPENGTCYPGHFADYEELREQLSSVSSFER
NPECELLISRESWSYIVEKPNPENGTCYPGHFADYEELREQLSSVSSFER
NPECELLISRESWSYIVEKPNPENGTCYPGHFADYEELREQLSSVSSFER
NPECELLISRESWSYIVEKPNPENGTCYPGHFADYEELREQLSSVSSFER
*************************************************

360       370       380       390       400
          |         |         |         |         |
FEIFPKESSWPNHTTTGVSASCSHNGESSFYKNLLWLTGKNGLYPNLSKS
FEIFPKESSWPNHTTTGVSASCSHNGESSFYKNLLWLTGKNGLYPNLSKS
FEIFPKESSWPNHTTTGVSASCSHNGESSFYKNLLWLTGKNGLYPNLSKS
FEIFPKESSWPNHTTTGVSASCSHNGESSFYKNLLWLTGKNGLYPNLSKS
*************************************************

410       420       430       440       450
          |         |         |         |         |
YANNKEKEVLVLWGVHHPPNIGDQRALYHKENAYVSVVSSHYSRKFTPEI
YANNKEKEVLVLWGVHHPPNIGDQRALYHKENAYVSVVSSHYSRKFTPEI
YANNKEKEVLVLWGVHHPPNIGDQRALYHKENAYVSVVSSHYSRKFTPEI
YANNKEKEVLVLWGVHHPPNIGDQRALYHKENAYVSVVSSHYSRKFTPEI
*************************************************

460       470       480       490       500
          |         |         |         |         |
AKRPKVRDQEGRINYYWTLLEPGDTIIFEANGNLIAPRYAFALSRGFGSG
AKRPKVRDQEGRINYYWTLLEPGDTIIFEANGNLIAPRYAFALSRGFGSG
AKRPKVRDQEGRINYYWTLLEPGDTIIFEANGLNIAPRYAFALSRGFGSG
AKRPKVRDQEGRINYYWTLLEPGDTIIFEANGNLIAPRYAFALSRGFGSG
*************************************************
```

```
fliCD2D3LHA1_2SI  IINS (SEQ ID NO: 511)
fljBD2D3LHA1_2SI  IINS (SEQ ID NO: 512)
EcoliD2D3LHA1_2SI IINS (SEQ ID NO: 513)
BsubD2D3LHA1_2SI  IINS (SEQ ID NO: 514)
                  ****
```

Alignment data:
Alignment length: 504
Identity (*): 330 is 65.48%
Strongly similar (:): 69 is 13.69%
Weakly similar (.): 32 is 6.35%
Different: 73 is 14.48%
Sequence 0001: fliCD2D3LHA1_2SI (501 residues).
Sequence 0002: fljBD2D3LHA1_2SI (500 residues).
Sequence 0003: EcoliD2D3LHA1_2SI (503 residues).
Sequence 0004: BsubD2D3LHA1_2SI (486 residues).

Alternatively, at least a portion of a naturally occurring flagellin can be replaced with at least a portion of an artificial hinge region, which can be employed in the compositions, fusion proteins and methods of the invention. The naturally occurring hinge region is the hinge region that is present in the native flagellin. For example, amino acids 176-415 of SEQ ID NO: 12, amino acids 174-422 of SEQ ID NO: 20 and amino acids 173-464 of SEQ ID NO: 16, are the amino acids corresponding to the natural hinge region of STF2, E. coli fliC and S. muenchen flagellin, fliC, respectively. "Artificial," as used herein in reference to a hinge region of a flagellin, means a hinge region that is inserted in the native flagellin in any region of the flagellin that contains or contained the native hinge region.

The hinge region of a flagellin can be deleted and replaced with at least a portion of an antigen protein described herein (e.g., HA viral antigens, M2 viral antigens, M2e viral antigens, HPV antigens, RSV antigens). In an embodiment, a flagellin lacking at least a portion of a hinge region can be associated with a particle and at least one antigen.

An artificial hinge region can be employed in a flagellin that lacks at least a portion of a hinge region, which may facilitate interaction of the carboxy- and amino-terminus of the flagellin for binding to TLR5 and, thus, activation of the TLR5 innate signal transduction pathway. A flagellin lacking at least a portion of a hinge region is designated by the name of the flagellin followed by a "Δ." For example, an STF2 (e.g., SEQ ID NO: 12) that lacks at least a portion of a hinge region is referenced to as "STF2Δ" or "fljB/STF2Δ" (e.g., SEQ ID NO: 15).

In an embodiment, the association of the Toll-like Receptor agonist and the antigen with the particle, such as a nanoparticle, can include a covalent bond (e.g., a non-polar bond, a polar bond). In another embodiment, the association of the Toll-like Receptor agonist and the antigen with the nanoparticle is a noncovalent bond, such as at least one member selected from the group consisting of a hydrogen bond, a van der Waals interaction, an ionic bond, a hydrophobic interaction and a dipole-dipole bond.

The compositions of the invention can include a particle that is of a sufficient size to permit the Toll-like Receptor agonist to bind a Toll-like Receptor on a cell for example, about 20 nm to about 2000 nm (e.g., 20 nm, 50 nm, 100 nm, 200 nm, 500 nm, 1000 nm). The particles employed in the compositions of the invention, such as a nanoparticle, can be of a size to permit entry into the cell about 20 nm to about 1000 nm. The particle size may permit entry of the particle into the cell. The particle size may permit partial entry into the cell. For example, the particle may partially enter the cell in a manner to permit a portion of the particle associated with the antigen, such as an influenza viral antigen, an RSV antigen, an HPV antigen and a flaviviral antigen, to remain on an extracellular surface of the cell, thereby permitting the antigen to be presented in a manner to promote an adaptive immune response.

In an embodiment, the antigen associated with the particle can be a protein antigen, such as at least one member selected from the group consisting of a bacterial protein antigen, a viral protein antigen, a parasitic protein antigen, a mycoplasma protein antigen, a tumor protein antigen and an allergen protein antigen. The viral protein antigen can be at least one member selected from the group consisting of an influenza viral protein antigen, a respiratory synctial viral protein antigen (e.g., SEQ ID NOs: 519, 522, 524, 526-544, 546-551, 577-580, 582, 586, 611, 612, 617, 627 and 840-843) and a flavivirus protein antigen (e.g., SEQ ID NOs: 339, 343, 345, 347, 351-355, 371, 381-384, 387-390, 636, 638, 640, 642, 644, 646, 648, 650, 652, 654, 656, 658, 341, 356, 358-361, 379, 443, 444, 337, 349, 362-370, 372, 373, 375, 377, 379, 380, 385, 386 and 391-442).

The influenza viral antigen can include at least one integral membrane protein antigen, such as at least a portion of at least one member selected from the group consisting of a haemagglutinin membrane protein (e.g., at least a portion of three haemagglutinin membrane proteins are associated with the particle), a neuraminidase membrane protein and a matrix 2 membrane protein (e.g., at least four matrix 2 membrane proteins). Exemplary haemagglutinin proteins for use in the compositions with particles include SEQ ID NOs: 228-281, 283-295, 456, 481, 499, 662, 665, 813 and 826-831. Exemplary matrix 2 proteins for use in the invention include ectodomain proteins of M2 (M2e), such as 296, 298, 300-321, 323-336, 485, 507 and 666.

Particles for use in the invention can be biodegradable particles. "Biodegradable," as used herein, means that the particle is capable of being decomposed under natural or biological conditions, such as in a bodily fluid (e.g., blood, nasal mucosa, skin) of a mammal.

The Toll-like Receptor and antigen in the compositions that include a particle can be components of a fusion protein associated with the particle. Compositions that have at least one particle and include at least one member selected from the group consisting of an R0 construct, an R3 construct, an R3D0 construct, an R3-2xAg construct, an D3N construct, an D3NCs construct and an D1 construct and at least a portion of at least one antigen associated with the particle have in a molar ratio of the flagellin construct to antigen no greater than about 1, can further include alum, liposomes, adjuvants, carriers, viruses (e.g., adenovirus, poxvirus, alphavirus), bacteria or a nucleic acid (e.g., plasmid DNA).

Bilayer lipids can form into closed spherical shell-like structures referred to as liposomes. Liposomes employed in the compositions of the invention can be prepared using a variety of established liposome preparatory techniques. For example, sonication, chelate dialysis, homogenization, solvent infusion coupled with extrusion, freeze-thaw extrusion and microemulsification as described, for example, in U.S. Pat. Nos. 4,728,578, 4,728,575, 4,533,254 and 4,737,323; and Mayer et al., *Biochimica et Biophysica Acta*, 858:161-168 (1986), Hope et al., *Biochimica et Biophysica Acta*, 812: 55-65 (1985), Mahew et al., *Methods In Enzymology*, 149: 64-77 (1987), Mahew et al., *Biochimica et Biophysica Acta*, 75:169-174 (1984) and Cheng et al., *Investigative Radiology*, 22:47-55 (1987).

The materials to prepare liposomes for use in the compositions of the invention described herein can include natural or synthetic materials. Such materials include lipids of at least one member selected from the group consisting of cholesterol, phosphatidylcholine, phosphatidylethanolamine, phosphatidylserine, phosphatidylglycerol, phosphatidic acid, phosphatidylinositol, lysolipids, fatty acids, sphingomyelin, glycosphingolipids, glucolipids, glycolipids, sulphatides, ester-linked fatty acids and polymerizable lipids. Liposomes may be synthesized in the absence or presence of incorporated glycolipid, complex carbohydrate, protein or synthetic polymer, employing conventional procedures. The surface of a liposome may also be modified with a polymer, for example, with polyethylene glycol (PEG). Lipids incorporated within a lipid matrix should form a liposome under physiologically relevant conditions, with suitable biodistribution and clearance properties.

Polymerized liposomes are self-assembled aggregates of lipid molecules that offer versatility in particle size and surface chemistry. Polymerized liposomes are described, for example, in U.S. Pat. Nos. 5,512,294 and 6,132,764, the teachings of which are hereby incorporated by reference herein in their entirety. The hydrophobic tail groups of polymerizable lipids are derivatized with polymerizable groups, such as diacetylene groups, which irreversibly cross-link, or polymerize, when exposed to ultraviolet light or other radical, anionic or cationic, initiating species, while maintaining the distribution of functional groups at the surface of the liposome. The resulting polymerized liposome particle is stabilized against fusion with cell membranes or other liposomes and stabilized towards enzymatic degradation. The size of the polymerized liposomes can be controlled by extrusion or other methods known to those skilled in the art. Polymerized liposomes may be comprised of polymerizable lipids, but may also include saturated and non-alkyne, unsaturated lipids. The polymerized liposomes can be a mixture of lipids which provide different functional groups on the hydrophilic exposed surface, such as biotin, amines, cyano, carboxylic acids, isothiocyanates, thiols, disulfides and alkyl hydrazines. These groups can be used for association of the antigen component in a fusion protein of the invention.

Liposomes can also be prepared using any one of a variety of conventional liposome preparatory techniques, such as sonication, chelate dialysis, homogenization, solvent infusion coupled with extrusion, freeze-thaw extrusion and microemulsification, as described, for example, in U.S. Pat. Nos. 4,728,578; 4,533,254; 4,728,575; 4,737,323; 4,753,788 and 4,935,171, the teachings of all of which are incorporated herein by reference in their entirety.

Materials that may be utilized in preparing the liposomes of the present invention include any of the materials or combinations suitable in liposome construction, including either natural or synthetic origin. Such materials include lipids of at least one member selected from the group consisting of cholesterol, phosphatidylcholine, phosphatidylethanolamine, phosphatidylserine, phosphatidylglycerol, phosphatidic acid, phosphatidylinositol, lysolipids, fatty acids, sphingomyelin, glycosphingolipids, glucolipids, glycolipids, sulphatides, lipids with amide, ether, ester-linked fatty acids and polymerizable lipids.

A composition can contain multiple particles made of different materials or different ratios of the same materials and/or differ in properties such as size or shape.

Various polymers, e.g., biocompatible polymers, which may be biodegradable, can be used to make the particles as described in U.S. Patent Application No.: 20080069857, the teachings of which are hereby incorporated by reference on their entirety. The polymers may be homopolymers, copolymers (including block copolymers), straight, branched-chain, or crosslinked. Suitable biocompatible polymers, a number of which are biodegradable include, for example, poly(lactides), poly(glycolides), poly(lactide-co-glycolides), poly(lactic acids), poly(glycolic acids), poly(lactic acid-co-glycolic acids), polycaprolactone, polycarbonates, polyesteramides, poly(beta-amino ester)s, polyanhydrides, poly(amides), poly (amino acids), polyethylene glycol and derivatives thereof, polyorthoesters, polyacetals, polycyanoacrylates, polyetheresters, poly(dioxanone)s, poly(alkylene alkylates), copolymers of polyethylene glycol and polyorthoesters, biodegradable polyurethanes. Other polymers include poly(ethers) such as poly)ethylene oxide), poly(ethylene glycol), and poly (tetramethylene oxide); vinyl polymers-poly(acrylates) and poly(methacrylates) such as methyl, ethyl, other alkyl, hydroxyethyl methacrylate, acrylic and methacrylic acids, and others such as poly(vinyl alcohol), poly(vinyl pyrolidone), and poly(vinyl acetate); poly(urethanes); cellulose and its derivatives such as alkyl, hydroxyalkyl, ethers, esters, nitrocellulose, and various cellulose acetates; poly(siloxanes). Other polymeric materials include those based on naturally occurring materials such as polysaccharides (e.g., alginatechitosan, agarose, hyaluronic acid), gelatin, collagen, and/or other proteins, and mixtures and/or modified forms thereof. Chemical or biological derivatives of any of the polymers disclosed herein (e.g., substitutions, addition of chemical groups, for example, alkyl, alkylene, hydroxylations, oxidations, and other modifications routinely made by those skilled in the art) can also be employed in the compositions described herein.

Additional exemplary polymers include cellulose derivatives such as carboxymethylcellulose, polycarbamates or polyureas, cross-linked poly(vinyl acetate) and the like, ethylene-vinyl ester copolymers, ethylene-vinyl hexanoate copolymer, ethylene-vinyl propionate copolymer, ethylene-vinyl butyrate copolymer, ethylene-vinyl pentantoate copolymer, ethylene-vinyl trimethyl acetate copolymer, ethylene-vinyl diethyl acetate copolymer, ethylene-vinyl 3-methyl butanoate copolymer, ethylene-vinyl 3-3-dimethyl butanoate copolymer and ethylene-vinyl benzoate copolymer, or mixtures thereof.

In still another embodiment, the invention is a composition comprising at least one nanoparticle that includes at least one Toll-like Receptor 7 agonist, at least one Toll-like Receptor 5 agonist and at least one antigen, wherein the Toll-like Receptor 7 agonist and the antigen are contained within the nanoparticle and the Toll-like Receptor 5 agonist is associated with an outer surface of the nanoparticle, which can, optionally, further include at least one additional Toll-like Receptor agonist selected from the group consisting of a Toll-like Receptor 8 agonist and a Toll-like Receptor 9 agonist. A change in a pH inside the cell relative to an extracellular pH can dissociate at least one additional Toll-like Receptor agonist from the nanoparticle. A molar ratio that consists of a sum of a molar concentration of the Toll-like Receptor 7 agonist and the Toll-like Receptor 5 agonist to an antigen molar concentration can be no greater than about 1.

In a further embodiment, the invention is a composition comprising at least one particle that includes at least a portion of at least one Toll-like Receptor 5 agonist, at least a portion of at least one antigen, and at least a portion of at least one additional Toll-like Receptor agonist selected from the group consisting of a Toll-like Receptor 7 agonist, a Toll-like Receptor 8 agonist and a Toll-like Receptor 9 agonist, wherein the additional Toll-like Receptor agonist and, optionally, the antigen are contained within the particle and the Toll-like Receptor 5 agonist is associated with an outer surface of the particle.

In yet another embodiment, the invention is a method of making a nanoparticle composition, comprising the steps of combining at least a portion of at least one Toll-like Receptor agonist with at least a portion of at least one nanoparticle to form an association between the Toll-like Receptor agonist and the nanoparticle; and combining at least a portion of at least one antigen with the Toll-like Receptor agonist associated with the nanoparticle, wherein a molar ratio of the Toll-like Receptor agonist to the antigen is no greater than about 1, thereby forming the nanoparticle composition.

In still another embodiment, the invention is a method of making a nanoparticle composition, comprising the steps of associating at least a portion of at least one Toll-like Receptor 5 agonist with a nanoparticle; containing at least a portion of at least one Toll-like Receptor agonist selected from the group consisting of a Toll-like Receptor 7 agonist, a Toll-like Receptor 8 agonist and a Toll-like Receptor 9 agonist within the nanoparticle; and combining the nanoparticle containing the Toll-like Receptor agonist with at least a portion of at least one antigen, thereby forming the nanoparticle composition.

Another embodiment of the invention is a method of stimulating an immune response in a subject, comprising the step of administering to the subject a composition that includes at least one nanoparticle comprising at least a portion of at least one Toll-like Receptor agonist and at least a portion of at least one antigen, wherein the Toll-like Receptor agonist and the antigen are associated with the nanoparticle and the molar ratio of the Toll-like Receptor agonist to the antigen is no greater than about 1.

An additional embodiment of the invention is a method of stimulating an immune response in a subject, comprising the step of administering to the subject a composition that includes at least one nanoparticle comprising at least a portion of at least one Toll-like Receptor 7 agonist, at least a portion of at least one Toll-like Receptor 5 agonist and at least a portion of at least one antigen, wherein the Toll-like Receptor 7 agonist and the antigen are contained within the nanoparticle and the Toll-like Receptor 5 agonist is associated with an outer surface of the nanoparticle. The nanoparticle further includes at least a portion of at least one additional Toll-like Receptor agonist selected from the group consisting of Toll-like Receptor 8 agonist and a Toll-like Receptor 9 agonist.

In a further embodiment, the invention is a method of stimulating an immune response in a subject, comprising the step of administering to the subject a composition that includes at least one nanoparticle comprising at least a portion of at least one Toll-like Receptor 5 agonist, at least a portion of at least one antigen and at least a portion of at least one additional Toll-like Receptor agonist selected from the group consisting of a Toll-like Receptor 7 agonist, a Toll-like Receptor 8 agonist and a Toll-like Receptor 9 agonist, wherein the additional Toll-like Receptor agonist and, optionally, the antigen are contained within the nanoparticle and the Toll-like Receptor 5 agonist is associated with a surface of the nanoparticle. The antigen and the Toll-like Receptor 5 agonist is associated with an outer surface of the nanoparticle. The average diameter of the particle is at least one member selected from the group consisting of between about 10 to about 200 nanometers, between about 0.5 to about 5 microns and between about 5 to about 10 microns.

The particle for use in the methods described herein can be a nanoparticle, a liposome, a viral particle, a plasmid, a fungal particle (e.g., a polysaccharide fungal particle), a microparticle, such as at least one member selected from the group consisting of a polystyrene microparticle and a polyvinyltoluene microparticle. The average diameter of the microparticle can be at least one diameter selected from the group consisting of about 0.1 µm, about 0.2 µm, about 0.4 µm, about 0.5 µm, about 1 µm and about 2 µm.

A composition comprising at least one particle that includes at least a portion of at least one intracellular signal regulator and at least a portion of at least one Toll-like Receptor agonist, wherein the intracellular signal regulator is contained within the particle and the Toll-like Receptor agonist is associated with an outer surface of the particle. A molar ratio of the Toll-like Receptor agonist to the intracellular signal regulator is no greater than about 1. The particle size may permit entry of the particle into the cell. Once in the cell, a change in a pH inside the cell relative to an extracellular pH dissociates the intracellular signal regulator from the particle.

The compositions that comprise at least one particle that includes at least a portion of at least one intracellular signal regulator and at least a portion of at least one Toll-like Receptor 5 agonist, flagellin construct, such as a R0 construct, an R3 construct, an R3D0 construct, an R3-2xAg construct, a D3N construct, a D3NCs construct and a D1 construct, or fusion protein of the invention that includes a TLR 5 agonist can further include at least one additional Toll-like Receptor agonist selected from the group consisting of a Toll-like Receptor 7 agonist, a Toll-like Receptor 8 agonist and a Toll-like Receptor 9 agonist contained within the particle.

In an additional embodiment, the invention is a method of making a particle composition, comprising the steps of containing at least a portion of at least one intracellular signal regulator with at least one particle; and associating at least a portion of at least one Toll-like Receptor agonist with the particle, thereby forming the particle composition.

Antigens for use in the fusion proteins, compositions and methods of the invention include viral antigens, such as influenza viral antigens, RSV antigens, HPV antigens and flaviviral antigens.

Influenza viral antigens can be HA antigens, M2 antigens and neuraminidase antigens. Hemagglutinin (HA) is a surface glycoprotein on a virus (e.g., an influenza virus) that is responsible for binding to N-AcetylNeuraminic Acid (NeuNAc; also referred to as "sialic acid") on host cells and subsequent fusion of viral and host membranes. HA acquired its name by virtue of its ability to cause red blood cells to clump, or agglutinate. Influenza HA is a trimer consisting of the three monomeric (HA0) subunits. HA performs two critical functions during the infection process: binding to a cell surface sialyloligosaccharide receptor and fusion of virus and host cell membrane. Following binding of the HA trimer to the plasma membrane of a host cell, the host cell membrane engulfs the virus in an endosome and attempts to digest the contents of the endosome by acidifying its interior and transferring it to a lysosome in the host cell. However, the acidic environment of the lysosome destabilizes HA, resulting in partial unfolding of HA0 which exposes a protease-sensitive site (the maturaional cleaveage site) that is cleaved by a host protease to form HA1 and HA2 subunits which are connected by a single disulfide bond (Wiley, D. C., et al., *Annu. Rev.*

Biochem. 56:365-394 (1987)). Cleavage occurs at a specific amino acid residue and generates a hydrophobic amino terminus for the HA2 subunit. This hydrophobic terminus of HA2 mediates fusion between the viral envelope and the endosomal membrane of the host cell and releases the contents of the virion into the cytoplasm of the cell, a process known as uncoating. Thus, cleavage of the HA polypeptide is a requirement for infectivity.

The crystal structure of several viral hemagglutinins has been determined (see, for example, Wilson, I. A., et al., *Nature* 289:366-373 (1981); Chen, J., et al., *Cell* 95:409-417 (1998); Ha, Y., et al., *The EMBO Journal* 21: 865-875 (2002); Russell, R. J., et al., *Virology* 325:287-296 (2004); and Cox, N. J., et al., In: Toply and Wilson's Microbiology and Microbial Infections, eds. B. W. J. Mathy, et al., Vol. 1 ($9^{th}$ ed.) New York, N.Y., Oxford Univ. Press, Ch. 32, p. 634 (1998)). X-ray crystallographic structures show that HA is folded into two structural components or domains—a globular head and a fibrous stalk. The globular head includes HA1, including that part of HA1 that binds to sialic acid (also referred to as the "receptor binding site or domain" or "sialic acid binding site or domain"), and antiparallel β-sheets. The fibrous stalk is more proximal to the viral membrane and consists of all of HA2 and part of HA1, including the cleavage site between HA1 and HA2.

There are fifteen known subtypes of Influenza A HA (H1-H15) that share between about 40 to about 60% sequence identity (World Health Organization BULL. World Health Organ., 58:585-591 (1980)). Influenza viruses containing all 15 HA subtypes have been isolated from avian species (H5, H7, and H9), equine (H3 and H7), seals (H3, H4 and H7), whales (H1 and H13) and swine (H1, H3, and H9). Subtypes of influenza A virus are generally named according to the particular antigenic determinants of HA (H, 15 major types) and neuraminidase (N, about 9 major types). For example, subtypes include influenza A (H2N1), A(H3N2), A(H5N1), A(H7N2), A(H9N2), A(H1N1), A(H3N1) and A(H5N2). In the last century, three subtypes of influenza A resulted in pandemics: H1 in 1918 and 1977; H2 in 1957 and H3 in 1968. In 1997, an H5 avian virus and in 1999, an H9 virus, resulted in outbreaks of respiratory disease in Hong Kong. HA from influenza type B viruses have been isolated from humans and seals and are not divided into subtypes.

A host infected with influenza can mount an antibody response to the globular head of HA that protects that host from subsequent infection with the same strain of virus by blocking the interaction between HA and the host cell, i.e., neutralizing the infectivity of the virus. Due to the low fidelity and high rate of influenza RNA replication, the virus is constantly experiencing minor mutations in the HA gene that preserve the globular head structure and host cell interaction, but may allow progeny virus to escape immune surveillance. These point mutations are referred to as "antigenic drift." In addition, if a single host is simultaneously infected with two different strains of influenza A, a new subtype of virus may emerge as a result of reassortment, or the exchange of the RNA segments, or genes, between different strains of influenza A viruses. The viruses emerging from reassortment present the human immune system with a new antigenic experience that usually results in high morbidity and mortality. This type of drastic antigenic change is known as "antigenic shift." Since type B influenza viruses circulate almost exclusively in humans, these viruses cannot undergo reassortment with animal strains and, thus, are changed only by antigenic drift.

Immunity to HA can reduce the likelihood of infection and severity of disease if infection does occur. HA is an important antigenic target and the efficacy of vaccines depends on the antigenic match between the vaccine strain and the circulating strain. Since the hemagglutinin protein readily undergoes antigenic shift and drift in order to evade the host's immune defense, traditional vaccines must be based on currently circulating influenza strains and annually updated. Annual updates of influenza vaccines are not only costly they also require significant amounts of production time and manufacturing infrastructure. A vaccine composition based on invariant regions of the virus may provide broadly cross-reactive protection.

In contrast to the globular head of HA, changes in amino acid residues surrounding the maturational cleavage site of HA are limited due to functional constraints. Amino acid residues surrounding the HA maturational cleavage site influence recognition and therefore cleavability of the site by the host protease. Since the virus does not code for the protease, changes in the amino acid residues surrounding the maturational cleavage site are restricted. As a consequence a peptide of about 20 amino acids spanning the maturational cleavage site remains genetically stable across influenza viruses of the same HA subtype (WO 2004/080403; Bianchi, et al. *J Virol* 79:7380-7388 (2005)) or as branched peptides (Horvath, et al *Immunol Letters* 60:127-136(1998), Nagy, et at *Scand J Immunol* 40:281-291 (1994)).

The influenza A viral HA protein can be at least one member selected from the group consisting of H1, H2, H3, H5, H7 and H9. The portion of an HA antigen for use in the invention can be at globular head of an HA. "A globular head," as that phrase is used herein, refers to a portion of a protein of a naturally occurring viral hemagglutinin that includes the receptor or sialic acid binding regions. "Globular head," is also referred to herein as a "globular domain." The globular head of viral hemagglutinin proteins has been determined based on x-ray crystallography as described, for example, by Wilson I. A., et al. *Nature* 289:366-373 (1981); Chen, J., et al., *Cell* 95:409-417 (1998); Ha Y., et al., *The EMBO Journal* 21:865-875 (2002); Russell, R. J., et al., *Virology* 325:287-296 (2004); and Cox, N. J., et al., In: Toply and Wilson's Microbiology and Microbial Infections, eds. B W J Mathy, et al., Vol. 1 ($9^{th}$ ed.) New York, N.Y., Oxford Univ. Press, Ch. 32, p. 634 (1998). The globular head of a naturally occurring viral hemagglutinin is a component of the HA1 subunit of, for example, influenza viral hemagglutinin. In addition to the receptor binding domain, the globular head can include the $E^-$ subdomain and $F^-$ subdomain as described, for example, by Ha, Y., et al. The *EMBO Journal* 21:865-875 (2002).

HA proteins for use in the invention include PR8 HA (SEQ ID NO: 228) (Gamblin, et al., *Science* 303:1838-1842 (2005) PDB Accession Number 1RU7); mature A/Viet Nam 1203/2004 HA (SEQ ID NO: 229); Indonesia HA (SEQ ID NO: 230); New Caledonia HA (H1NC; SEQ ID NO: 231); A/South Carolina/1/18 (SEQ ID NO: 232); Wisconsin HA (H3Wis; SEQ ID NO: 233); and A/X31 subtype H3N2 (H3X31; SEQ ID NO: 234; PDB Accession No: 1VIU)). Exemplary HA antigens include HA1-1 antigens, HA1-2 antigens and HA1-3 antigens. Exemplary methods to make HA1-1, HA1-2 and HA1-3 antigen are described in U.S. application Ser. No. 11/714,873.

"HA1-1," as used herein, refers to a protein portion of a viral hemagglutinin that includes at least about one β-sandwich that includes the substrate binding site, which includes at least about two β-sheets, at least about two to about three short α-helixes, at least one small β-sheet and at least one additional small β-sandwich at the bottom of the molecule and at least about four disulfide bonds. The β-sandwich that includes the substrate binding site of the HA1-1 includes at least about four β-strands as the top sheet and at least about three to about four β-strands as the bottom sheet. At least about one α-helix of the HA1-1 portion is located by the side of β-sandwich that includes the substrate binding site and at least about one to about two are located at the bottom of the β-sandwich that includes the substrate binding site. The small β-sandwich of the HA1-1 can include at least about two to about three β-strands in each β-sheet; or about three to about four β-strands. Exemplary HA1-1 protein portions include SEQ ID NOs: 235-248, 456 and 662.

"HA1-2," as used herein, refers to a protein portion of a viral hemagglutinin that includes at least about one β-sandwich that includes the substrate binding site, at least about two to about three short α-helixes, at least about one small β-sheet at the bottom of the molecule and at least about two disulfide bonds. A β-strand in a viral hemagglutinin can include between about two to about 15 amino acids. A small β-strand can include about two amino acids; or between about two to about three amino acids; or between about two to four amino acids or between about two to about five amino acids. A small β-sheet can include between about two to about three β-strands; or between about three to about four β-strands. The β-sandwich that includes the substrate binding site of HA1-2 can further include at least about four β-strands as the top sheet and at least about three to about four β-strands as the bottom sheet. At least about one α-helix of the HA1-2 portion is located by the side of the β-sandwich that includes the substrate binding site and at least about one to about two are located at the bottom of the β-sandwich that includes the substrate binding site. Exemplary HA2-2 protein portions include SEQ ID NOs: 249-263, 481 and 499. "HA1-3," as used herein, refers to a protein portion of a viral hemagglutinin that includes at least one β-sandwich that includes the substrate binding site, at least about two short α-helixes and at least one disulfide bond. "β-sandwich," as used herein, refers to at least about two sets of beta-sheets that form at least about one interactive layer. "Substrate binding site," as used herein in reference to the β-sandwich, means any part of the portion of the naturally occurring viral hemagglutinin that has the capacity to interact or bind to a molecule. For example, the β-sandwich that includes the substrate binding site of the portion can include a portion that binds sialic acid. The β-sandwich that includes the substrate binding site of HA1-3 can further include at least about four β-strands as the top sheet and at least about three β strands as the bottom sheet. At least about one α-helix of the HA1-1 portion is located by the side of the β-sandwich that includes the substrate binding site and at least one other α-helix is located at the bottom of the β-sandwich that includes the substrate binding site. A short α-helix can include less than about 5 turns (2, 3, 4, 5 turns) in an α-helix. An α-helix in a viral hemagglutinin can be between one to about 15 turns; or between about two to 15 turns. Exemplary HA1-3 protein portions include SEQ ID NOs: 264-273.

The maturation cleavage site of HA can be employed in the compositions, fusion proteins and methods of the invention. The maturational cleavage site antigen can be at least one member selected from the group consisting of (SEQ ID NOs: 274-281 and NVPEKQTRGIFGAIAGFIE (H3) (SEQ ID NO: 283), NIPSIQSRGLFGAIAGFIE (H1) (SEQ ID NO: 284), PAKLLKERGFFGAIAGFLE (FLU B) (SEQ ID NO: 285), RERRRKKRGLFGAIAGFIE (H5) (SEQ ID NO: 286), RGLXGAIAGFIE (SEQ ID NO: 287), RGLXGAIAGFIE (SEQ ID NO: 288), RGLFGAIAGFIE (Influenza A conserved region) (SEQ ID NO: 289) and RGFFGAIAGFIE (Influenza B conserved region) (SEQ ID NO: 290). Maturational cleavage site antigen is also referred to herein as "cleavage fragment," "CF," "cleavage site," or "CS." Exemplary sequences of maturation cleavage site peptides of HA can also include the peptides listed below:

| Sequence | Subtype |
|---|---|
| NVPEKQTRGIFGAIAGFIE | A/H3N2 (SEQ ID NO: 291) |
| NVPQIESRGLFGAIAGFIE | A/H2N1 (SEQ ID NO: 292) |
| NIPSIQSRGLFGAIAGFIE | A/H1N1 (SEQ ID NO: 293) |
| RERRRKKRGLFGAIAGFIE | A/H5N1 (SEQ ID NO: 294) |
| PAKLLKERGFFGAIAGFLE | B/HA (SEQ ID NO: 295) |

At least a portion of a matrix 2 (M2) influenza protein can be employed in the compositions, fusion proteins and methods of the invention. In a particular embodiment, the portion of the M2 protein includes the ectodomain of the M2 protein (M2e).

Matrix protein 2 (M2 or M2 protein) is a proton-selective integral membrane ion channel protein of the influenza A virus. M2 is a 97-amino acid protein expressed at low levels in mature virions and much higher levels on infected cells. The M2 protein forms a homotetramer that functions as an ion channel which is critical to the replication of the virus, thus, mutations in M2e are not as well tolerated as mutations in HA. M2 is abundantly expressed at the plasma membrane of virus-infected cells, but is generally underexpressed by virions. For example, a portion of an M2 sequence of influenza A is SEQ ID NO: 296, which is encoded by SEQ ID NO: 297. The native form of the M2 protein is a homotetramer (i.e., four identical disulfide-linked M2 protein molecules). Each of the units are helices stabilized by two disulfide bonds. M2 is activated by low pH. Each of the M2 protein molecules in the homotetramer consists of three domains: a 24 amino acid outer or N (amino)-terminal domain (e.g., SEQ ID NO: 298; also referred to herein as a "human consensus sequence"), which is encoded by SEQ ID NO: 299; a 19 hydrophobic amino acid transmembrane region, and a 54 amino acid inner or C (carboxy)-terminal domain. The M2 protein can vary depending upon the influenza viral subtype (e.g., H1 and H5 subtypes of influenza A) and influenza viral source (e.g., Puerto Rico, Thailand, New York, Hong Kong), as shown, for example, in exemplary amino-terminal sequences of M2 proteins (SEQ ID NOs: 300-321, 323-336, 485, 507 and 666) and as described in PCT/US2005/046662 (WO2006/069262).

The M2 protein has an important role in the life cycle of the influenza A virus. It is important in the uncoating stage where it permits the entry of protons into the viral particle, which lowers the pH inside the virus, resulting in dissociation of the viral matrix protein M1 from the ribonucleoprotein RNP. As a consequence, the virus coat is removed and the contents of the virus are released from the endosome into the cytoplasm of the host cell for infection.

The function of the M2 channel can be inhibited by antiviral drugs, such as amantadine and rimantadine, which prevent the virus from infecting the host cell. Such antiviral drugs usually bind the transmembrane region of the M2 protein and sterically block the ion channel created by the M2 protein, which prevents protons from entering and uncoating the virion.

The M2 protein for use in the compositions and methods of the invention can that include at least a portion of SEQ ID NO: 298 encoded by SEQ ID NO: 299 or at least a portion of SEQ ID NO: 300, encoded by SEQ ID NO: 322. The M2 protein can further include at least one member selected from the group consisting of SEQ ID NO: 323, SEQ ID NO: 324, SEQ ID NO: 325; SEQ ID NO: 326 (Flu A H5N1 M2e, 2004 Viet Nam Isolate with serine replacing cysteine); SEQ ID NO: 327 (Flu A H5N1 M2e, 2004 Viet Nam Isolate); SEQ ID NO: 328 (Flu A H5N1 M2e, Hong Kong 97 Isolate with serine replacing cysteine); SEQ ID NO: 329 (Flu A H5N1 M2e, Hong Kong 97 Isolate); SEQ ID NO: 330 (Flu A H7N2 M2e Chicken/New York 95 Isolate with serine replacing cysteine); SEQ ID NO: 331 (Flu A H7N2 M2e, Chicken/New York 95 Isolate); SEQ ID NO: 332 (Flu A H9N2 M2e, Hong Kong 99 Isolate with serine replacing cysteine); and SEQ ID NO: 333 (Flu A, Hong Kong 99 Isolate). Certain cysteine residues, for example, amino acids 16 and 18 of SEQ ID NO: 327; amino acids 17 and 19 of SEQ ID NOs: 329, 331 and 333 in the naturally occurring sequence of at least a portion of M2 protein can be replaced with a serine (see, SEQ ID NOs: 328, 330, 332 and 300, respectively).

The compositions that include Toll-like Receptor 5 agonists, fusion proteins and compositions described herein can include at least one viral antigen and at least one additional viral antigen that is distinct or similar to the viral antigen. For example, a fusion protein that includes the R32x Toll-like Receptor 5 agonist can include a maturational cleavage site peptide, a portion of an HA viral antigen (e.g., HA1-1, HA1-2) and at least a portion of a M2 protein Exemplary M2e proteins include SLLTEVETPIRNEWG-SRSNDSSDP (human influenza M2e (SEQ ID NO: 334)); GSGAG SLLTEVETPTRNEWECRCSDSSDP (Vietnam influenza M2e (SEQ ID NO: 335)) and GSGAGSLLTE-VETLTRNGWGCRCSDSSDP (Hong Kong influenza M2e (SEQ ID NO: 336)).

The antigen included in the compositions and employed in the methods of the invention can be at least a portion of at least one member selected from the group consisting of a West Nile viral protein, a Langat viral protein, a Kunjin viral protein, a Murray Valley encephalitis viral protein, a Japanese encephalitis viral protein, a Tick-borne encephalitis viral protein, Dengue 1 viral protein, Dengue 2 viral protein, Dengue 3 viral protein, Dengue 4 viral protein, hepatitis C viral protein and a Yellow fever viral protein (see, for example, PCT/US2006/001623 (WO2006/078657)).

The genus flavivirus is in the virus family Flaviviridae and consists of about 70 viruses. Mosquito or ticks transmit most of these viruses. Several flaviviruses are significant human pathogens, including the four dengue viruses (Den1, Den2, Den3 and Den4), yellow fever (YF), Japanese encephalitis (JE), West Nile (WN, also referred to herein as "WNV") and Tick-borne encephalitis (TBE) (Weaver S. C., et al., *Nat Rev Microbiol* 10: 789-801 (2004)). The flavivirus genus is divided into a number of serogroups based on cross-neutralization tests, including the dengue serogroup that contains four serologically and genetically distinct viruses termed DEN-1, DEN-2, DEN-3 and DEN-4.

Flaviviruses are small, enveloped viruses with icosahedral capsids. The flavivirus genome is a single-stranded positive-sense RNA (about 11 kb) that is directly translated by the host cell machinery following infection. The viral genome is translated as a single polypeptide that undergoes co- and post-translational cleavage by viral and cellular enzymes to generate three structural proteins of the flavivirus (the capsid (C), the membrane (M) and the envelope (E) proteins); and seven nonstructural proteins (NS1, NS2A, NS2B, NS3, NS4A, NS4B, and NS5) (Weaver, et al., *Annu Rev Microbiol* 1990: 44-649 (2004)). The viral capsid is composed of the C-protein, while both the M- and envelope proteins are located on the envelope surface of the virion (Weaver, S. C., et al., *Nat. Rev. Microbiol.* 10:789-801 (2004); Chambers et al., *Annu Rev. Microbiol.* 44: 649-688 (1990)). A major immunogen for flaviviruses is the membrane envelope protein.

A flavivirus can enter a host cell when the viral envelope protein binds to a receptor and responds by conformational rearrangement to the reduced pH of an endosome. The conformational change induces fusion of viral and host-cell membranes.

The envelope of a flavivirus may function as a receptor binding protein and to facilitate fusion of the virus and host cell membrane. Envelope proteins of flaviviruses have common structural (domains I, II and III) and functional features (receptor binding of virus and host cell and fusion functions) and are class II fusion glycoproteins (Lescar et al., *Cell* 105: 137-148 (2001)).

In the pre-fusion conformation, envelope proteins form homodimers on the outer surface of the virus particles (Rey, et al., *Nature* 375:291-298); Kuhn, et al., *Cell* 108:717-725 (2002); Mukhopadhyay, et al., *Science* 302:248 (2003)). Each envelope protein monomer folds into three structural domains (domains I, II and III) predominantly composed of β-strands. Domain I (also referred to herein as "I" or "DI") is centrally located in the structure and has an N-glycosylation site in glycosylated envelope proteins. Domain II (also referred to herein as "II" or "DII") of the envelope protein promotes dimerization and has a fusion loop that inserts into the target host membrane during the pH-dependent fusion of the virus (Modis, et al., *Nature* 427:313-319 (2004); Bressanelli, et al., *EMBO J* 23:728-738 (2004)). Domain III (also referred to herein as "III" or "DIII") is at the carboxy-terminus of the envelope protein. Domain III is also referred to as "domain B" in earlier antigenic mapping studies. Domain III has several epitopes that can elicit virus-neutralizing antibodies (Roehrig, *Adv Virus Res* 59:141-175 (2003)).

Domain I of the Tick-borne encephalitis envelope protein corresponds to amino acids 1-51, 137-189 and 285-302 of SEQ ID NO: 337; domain II of the Tick-borne encephalitis envelope protein of SEQ ID NO: 337 corresponds to amino acids 52-136 and 190-284; and domain III corresponds to amino acids 303-395 of SEQ ID NO: 337. (Rey, F. A., et al., *Nature* 375:291-298 (1995)). SEQ ID NO: 337 is encoded by SEQ ID NO: 338. Domain I of the Dengue 2 flavivirus envelope protein corresponds to amino acids 1-52, 132-193 and 280-296 of SEQ ID NO: 339; domain II corresponds to amino acids 53-131 and 194-279 of SEQ ID NO: 339; and domain III corresponds to amino acids 297-495 of SEQ ID NO: 339 (Modis, Y., et al., *Nature* 427:313-319 (2004)). The location of domains I, II and III of other flavivirus (e.g., West Nile virus, Japanese encephalitis, Dengue 1 virus, Dengue 3 virus and Dengue 4 virus) is based on homology of the Tick-borne encephalitis envelope protein domains and the Dengue 2 envelope protein domains. Thus, reference herein to domains of flavivirus proteins, in particular, flaviviruses other than Tick-borne encephalitis flavivirus envelope proteins and Dengue 2 flavivirus envelope proteins, are based on homology to domains in the Tick-borne encephalitis flavivirus envelope protein and the Dengue 2 flavivirus envelope protein.

The domain III of the envelope protein of the DEN flavivirus encodes the majority of the flavivirus type-specific contiguous critical/dominant neutralizing epitopes (Roehring, J. T., *Adv. Virus Res.* 59:141 (2003)), including the four DEN (DEN1, DEN2, DEN3, DEN4) viruses. Flavivirus envelope proteins are highly homologous. Exemplary envelope protein sequences are SEQ ID NOs: 341, 339, 343, 345, 347 and 349.

West Nile virus (WNV) is a single-stranded positive sense RNA envelope virus. It was first isolated and identified in the West Nile region of Uganda in 1937 from a febrile female adult (Smithburn, et al., *Am J Trop Med Hyg* 3:9-18 (1954)).

Japanese encephalitis (JE) virus is localized in Asia and northern Australia (about 50,000 cases with about 10,000 deaths annually).

The Dengue (DEN) disease is caused by four mosquito-borne, serologically related flaviviruses known as DEN-1 (also referred to herein as "Den1" or Den 1"), DEN-2 (also referred to herein as "Den2" or "Den 2"), DEN-3 (also referred to herein as "Den3" or "Den 3"), and DEN-4 (also referred to herein as "Den4" or Den 4"). The compositions, fusion proteins and polypeptides of the invention can include Den 1 SEQ ID NO: 351; Den 1 PR 94 (Puerto Rico, 1994) SEQ ID NO: 352; Den 3 SEQ ID NO: 354; and Den 4 SEQ ID NO: 355. SEQ ID NOs: 351, 352, 353, 354 and 355 are portions of domain III of Den1, Den2, Den3 and Den4 flaviviruses. Exemplary portions of Dengue viruses for use in the compositions, fusion proteins and methods of the invention include SEQ ID NOs: 339, 343, 345, 347, 351-355, 371, 381-384, 387-390, 636, 638, 640, 642, 644, 646, 648, 650, 652, 654, 656 and 658. "EI," "EII," and "EIII," as used herein, refer to domains I, II and III, respectively, of the West Nile flavivirus envelope protein. "JEI," "JEII," and "JEIII," as used herein, refer to domains I, II and III, respectively, of the Japanese encephalitis flavivirus envelope protein. "Den1 I," "Den1 II," and "Den1 III," as used herein refer to domains I, II and III, respectively, of the Dengue 1 flavivirus envelope protein. Likewise, designations for the domains of envelope proteins of other flaviviruses are referenced by the flavivirus name followed by the domain number (e.g., (Tick-borne) TBI (Tick-borne), TBII, TBIII, Den2 I, Den2 II, Den2 III).

Infection from flaviviruses, such as Dengue virus and West Nile virus, can cause serious illness and, in some cases, death. Dengue virus infection can generally result in flu-like illness that lasts for several weeks. In certain instances, infection from Dengue virus can result in Dengue hemorrhagic fever, which is characterized by acute vascular leakage, hemorrhagic phenomena (e.g., bleeding, bruising) and a high mortality rate. The treatment for Dengue viral infection includes rest, hydration and electrolyte replacement. Currently, there are no compositions that prevent infection caused by the Dengue virus. Infection by West Nile virus can lead to inflammation of the brain (encephalitis), the spinal cord (myelitis) and meningitis. There no particular treatments available for preventing or minimizing infection from West Nile virus. Infection from West Nile virus can be treated hydration and prevention of secondary infections, such as pneumonia. There is a need to develop new, improved and effective methods of treatment for preventing and managing disease associated with flavivirus infection.

The portion of an envelope protein of a flavivirus can include at least one member selected from the group consisting of at least a portion of domain I, at least a portion of domain II and at least a portion of domain III. When a domain is designated with a "+," for example "EIII+" or "JEIII+," the portion of the envelope protein referenced as "III" is one component of the total of that domain plus at least one of at least a portion of either or both of domains I and II. For example, "EIII+," as used herein, means the compositions, fusion proteins and polypeptides of the invention include domain III and at least a portion of domain I. "EIII+" is also referred to as "EI/III." "JEIII+" is also referred to as "JEI/III." Similarly, when compositions include domains of envelope proteins of flavivirus, the domains can be any combination of domains I, II, and III and can be designated based on the domain. For example, EI/II includes domain I and II of the West Nile flavivirus. The absence of a "+" in reference to a domain (e.g., EIII, JEIII, Den1 III) of an envelope protein employed in the compositions, fusion proteins and polypeptides of the invention means that the composition, fusion protein and polypeptide includes the referenced domain. For example, "Den1 III" means the compositions, fusion proteins and compositions include domain III, not domains I and II, of the Dengue 1 virus.

The West Nile viral envelope protein can include at least a portion of at least one member selected from the group consisting of SEQ ID NO: 356, which is an EIII+ amino acid sequence, the italicized amino acids are domain I of the envelope protein and the remaining sequence is domain III of the envelope protein; SEQ ID NO: 358, West Nile virus, Stanford, Conn., also referred to as "West Nile S"; SEQ ID NO: 359, West Nile virus, New York, N.Y., also referred to as "West Nile NY"; and SEQ ID NO: 360, SEQ ID NO: 356 is encoded by SEQ ID NO:357. LTSGHLKCRVKMEK-LQLKGT (SEQ ID NO: 361) West Nile Virus E peptide 001. Exemplary portions of West Nile viruses for use in the compositions, fusion proteins and methods of the invention include SEQ ID NOs: 341, 356, 358-361, 379, 443 and 444.

The Langat virus envelope protein for use in the compositions, fusion proteins and polypeptides of the invention can include at least a portion of SEQ ID NO: 362. The Kunjin virus envelope protein can include at least a portion of SEQ ID NO: 363. The Murray Valley encephalitis envelope protein can include at least a portion of SEQ ID NO: 364. The Japanese encephalitis envelope protein can include at least one member selected from the group consisting of at least a portion of SEQ ID NO: 365 and SEQ ID NO: 366. The Tick-borne encephalitis envelope protein can include at least a portion of SEQ ID NO: 367. The Yellow fever virus envelope protein can include at least a portion of SEQ ID NO: 368. The envelope protein of a flavivirus can include at least a portion of at least one member selected from the group consisting of SEQ ID NO: 369 and SEQ ID NO: 370. SEQ ID NOs: 362, 363, 364, 365, 366, 367, 368, 369 and 370 are portions of domain III of the viral envelope protein. EAEPPFGDSYII-IGVEPGQLKLNWFKK (SEQ ID NO: 371) Dengue 2 E peptide SLLTEVETPIRNEWGSRSNDSSDP BCRABL (SEQ ID NO: 372) wildtype peptide.

Additional exemplary portions of flavivirus for use in the compositions, fusion proteins and methods of the invention include SEQ ID NOs: 337, 349, 362-370, 372, 373, 375, 377, 379, 380, 385, 386 and 391-442. Additional exemplary fusion proteins and viral antigens for use in the compositions and methods of the invention include fusion proteins included in the sequence listing.

Exemplary influenza antigens, fusion proteins and nucleic acids encoding the antigens and fusion proteins include SEQ ID NOs: 451-507, 511-518, 702-711, 422, 723, 728-812 and 826-831.

In an additional embodiment, the invention includes a protein, peptide polypeptide having at least about 50.0%, at least about 60.0%, at least about 70.0%, at least about 75.0%, at least about 84.0%, at least about 80.0%, at least about 85.0%, at least about 86.0%, at least about 88.0%, at least about 90.0%, at least about 95.0%, at least about 98.0% and at least about 99.0% sequence identity to the proteins, antigen protein components, fusion proteins, amino acid sequences and flagellin components of the invention.

In another embodiment, the invention is an amino acid sequence or a nucleic acid sequence encoding the amino acid sequence having at least about 50.0%, at least about 60.0%, at least about 70.0%, at least about 75.0%, at least about 84.0%, at least about 80.0%, at least about 85.0%, at least about 86.0%, at least about 88.0%, at least about 90.0%, at least about 95.0%, at least about 98.0% and at least about 99.0% sequence identity to a contiguous amino acid sequence, without any insertions or deletions, as set forth in SEQ ID NOs: SEQ ID NOs: 28-34.

The percent identity of two amino acid sequences (or two nucleic acid sequences) can be determined by aligning the sequences for optimal comparison purposes (e.g., gaps can be introduced in the sequence of a first sequence). The amino acid sequence or nucleic acid sequences at corresponding positions are then compared, and the percent identity between the two sequences is a function of the number of identical positions shared by the sequences (i.e., % identity=# of identical positions/total # of positions×100). The length of the protein or nucleic acid encoding can be aligned for comparison purposes is at least about 30.0%, at least about 40.0%, at least about 50.0%, at least about 60.0%, at least about 70.0%, at least about 75.0%, at least about 80.0%, at least about 85.0%, at least about 90.0%, at least about 95.0%, at least about 98.0%, at least about 99.0% or 100%, of the length of the reference sequence, for example, the nucleic acid sequence of an antigen (e.g., SEQ ID NOs: 114-120, 523, 525, 545, 645, 647, 649, 651, 618, 459, 462, 476, 484), Toll-like Receptor agonist (e.g., SEQ ID NOs: 34, 22, 27) or fusion protein (e.g., SEQ ID NOs: 667-672, 553, 555, 569, 628, 630, 632, 634, 451-453, 455, 457, 463-465, 660 and 664) of the invention.

The actual comparison of the two sequences can be accomplished by well-known methods, for example, using a mathematical algorithm. A preferred, non-limiting example of such a mathematical algorithm is described in Karlin et al. (Proc. Natl. Acad. Sci. USA, 90:5873-5877 (1993), the teachings of which are hereby incorporated by reference in its entirety). Such an algorithm is incorporated into the BLASTN and BLASTX programs (version 2.2) as described in Schaffer et al. (Nucleic Acids Res., 29:2994-3005 (2001), the teachings of which are hereby incorporated by reference in its entirety). When utilizing BLAST and Gapped BLAST programs, the default parameters of the respective programs (e.g., BLASTN; available at the Internet site for the National Center for Biotechnology Information) can be used. In one embodiment, the database searched is a non-redundant (NR) database, and parameters for sequence comparison can be set at: no filters; Expect value of 10; Word Size of 3; the Matrix is BLOSUM62; and Gap Costs have an Existence of 11 and an Extension of 1.

Another mathematical algorithm employed for the comparison of sequences is the algorithm of Myers and Miller, CABIOS (1989), the teachings of which are hereby incorporated by reference in its entirety. Such an algorithm is incorporated into the ALIGN program (version 2.0), which is part of the GCG (Accelrys, San Diego, Calif.) sequence alignment software package. When utilizing the ALIGN program for comparing amino acid sequences, a PAM120 weight residue table, a gap length penalty of 12, and a gap penalty of 4 is used. Additional algorithms for sequence analysis are known in the art and include ADVANCE and ADAM as described in Torellis and Robotti (Comput. Appl. Biosci., 10: 3-5 (1994), the teachings of which are hereby incorporated by reference in its entirety); and FASTA described in Pearson and Lipman (*Proc. Natl. Acad. Sci USA*, 85: 2444-2448 (1988), the teachings of which are hereby incorporated by reference in its entirety).

The percent identity between two amino acid sequences can also be accomplished using the GAP program in the GCG software package (Accelrys, San Diego, Calif.) using either a Blossom 63 matrix or a PAM250 matrix, and a gap weight of 12, 10, 8, 6, or 4 and a length weight of 2, 3, or 4. In yet another embodiment, the percent identity between two nucleic acid sequences can be accomplished using the GAP program in the GCG software package (Accelrys, San Diego, Calif.), using a gap weight of 50 and a length weight of 3.

The nucleic acid sequence encoding an antigen protein component described herein, or flagellin component of the invention, polypeptides, amino acid sequences and fusion proteins of the invention can include nucleic acid sequences that hybridize to nucleic acid sequences or complements of nucleic acid sequences of the invention and nucleic acid sequences that encode amino acid sequences and fusion proteins of the invention under selective hybridization conditions (e.g., highly stringent hybridization conditions). As used herein, the terms "hybridizes under low stringency," "hybridizes under medium stringency," "hybridizes under high stringency," or "hybridizes under very high stringency conditions," describe conditions for hybridization and washing of the nucleic acid sequences. Guidance for performing hybridization reactions, which can include aqueous and nonaqueous methods, can be found in Aubusel, F. M., et al., Current Protocols in Molecular Biology, John Wiley & Sons, N.Y. (2001), the teachings of which are hereby incorporated herein in its entirety.

For applications that require high selectivity, relatively high stringency conditions to form hybrids can be employed. In solutions used for some membrane based hybridizations, addition of an organic solvent, such as formamide, allows the reaction to occur at a lower temperature. High stringency conditions are, for example, relatively low salt and/or high temperature conditions. High stringency are provided by about 0.02 M to about 0.10 M NaCl at temperatures of about 50° C. to about 70° C. High stringency conditions allow for limited numbers of mismatches between the two sequences. In order to achieve less stringent conditions, the salt concentration may be increased and/or the temperature may be decreased. Medium stringency conditions are achieved at a salt concentration of about 0.1 to about 0.25 M NaCl and a temperature of about 37° C. to about 55° C., while low stringency conditions are achieved at a salt concentration of about 0.15 M to about 0.9 M NaCl, and a temperature ranging from about 20° C. to about 55° C. Selection of components and conditions for hybridization are well known to those skilled in the art and are reviewed in Ausubel et al. (1997, Short Protocols in Molecular Biology, John Wiley & Sons, New York N.Y., Units 2.8-2.11, 3.18-3.19 and 4-64.9).

A "subject," as used herein, can be a mammal, such as a primate or rodent (e.g., rat, mouse). In a particular embodiment, the subject is a human.

An "effective amount," when referring to the amount of a composition and fusion protein of the invention, refers to that amount or dose of the composition and fusion protein, that, when administered to the subject is an amount sufficient for therapeutic efficacy (e.g., an amount sufficient to stimulate an immune response in the subject, an amount sufficient to provide protective immunity in the subject). The compositions and fusion proteins of the invention can be administered in a single dose or in multiple doses.

The methods of the present invention can be accomplished by the administration of the compositions and fusion proteins of the invention by enteral or parenteral means. Specifically, the route of administration is by oral ingestion (e.g., drink, tablet, capsule form) or intramuscular injection of the composition and fusion protein. Other routes of administration as also encompassed by the present invention including intravenous, intradermal, intraarterial, intraperitoneal, or subcutaneous routes, and intranasal administration. Suppositories or transdermal patches can also be employed.

The compositions, fusion proteins and proteins of the invention can be administered ex vivo to a subject's autologous dendritic cells. Following exposure of the dendritic cells to the composition and protein of the invention, the dendritic cells can be administered to the subject.

The compositions, fusion proteins and proteins of the invention can be administered alone or can be coadministered to the patient. Coadministration is meant to include simultaneous or sequential administration of the composition, protein or polypeptide of the invention individually or in combination. Where the composition and protein are administered individually, the mode of administration can be conducted sufficiently close in time to each other (for example, administration of the composition close in time to administration of the fusion protein) so that the effects on stimulating an immune response in a subject are maximal. It is also envisioned that multiple routes of administration (e.g., intramuscular, oral, transdermal) can be used to administer the compositions and proteins of the invention.

The compositions, fusion proteins and proteins of the invention can be administered alone or as admixtures with conventional excipients, for example, pharmaceutically, or physiologically, acceptable organic, or inorganic carrier substances suitable for enteral or parenteral application which do not deleteriously react with the extract. Suitable pharmaceutically acceptable carriers include water, salt solutions (such as Ringer's solution), alcohols, oils, gelatins and carbohydrates such as lactose, amylose or starch, fatty acid esters, hydroxymethycellulose, and polyvinyl pyrrolidine. Such preparations can be sterilized and, if desired, mixed with auxiliary agents such as lubricants, preservatives, stabilizers, wetting agents, emulsifiers, salts for influencing osmotic pressure, buffers, coloring, and/or aromatic substances and the like which do not deleteriously react with the compositions, proteins or polypeptides of the invention. The preparations can also be combined, when desired, with other active substances to reduce metabolic degradation. The compositions and proteins of the invention can be administered by is oral administration, such as a drink, intramuscular or intraperitoneal injection or intranasal delivery. The compositions and proteins alone, or when combined with an admixture, can be administered in a single or in more than one dose over a period of time to confer the desired effect.

When parenteral application is needed or desired, particularly suitable admixtures for the compositions, fusion proteins and proteins are injectable, sterile solutions, preferably oily or aqueous solutions, as well as suspensions, emulsions, or implants, including suppositories. In particular, carriers for parenteral administration include aqueous solutions of dextrose, saline, pure water, ethanol, glycerol, propylene glycol, peanut oil, sesame oil, polyoxyethylene-block polymers, and the like. Ampules are convenient unit dosages. The compositions, proteins or polypeptides can also be administered by transdermal pumps or patches. Pharmaceutical admixtures suitable for use in the present invention are well-known to those of skill in the art and are described, for example, in Pharmaceutical Sciences (17th Ed., Mack Pub. Co., Easton, Pa.) and WO 96/05309 the teachings of which are hereby incorporated by reference.

The compositions, fusion proteins and proteins of the invention can be administered to a subject on a support that presents the compositions, proteins and fusion proteins of the invention to the immune system of the subject to generate an immune response in the subject. The presentation of the compositions, proteins and fusion proteins of the invention would preferably include exposure of antigenic portions of the viral protein to generate antibodies. The components (e.g., PAMP and a viral protein) of the compositions, proteins and fusion proteins of the invention can be in close physical proximity to one another on the support. The support is biocompatible. "Biocompatible," as used herein, means that the support does not generate an immune response in the subject (e.g., the production of antibodies).

The dosage and frequency (single or multiple doses) administered to a subject can vary depending upon a variety of factors, including prior exposure to a viral antigen, a viral protein, the duration of viral infection, prior treatment of the viral infection, the route of administration of the composition, protein or polypeptide; size, age, sex, health, body weight, body mass index, and diet of the subject; nature and extent of symptoms of viral exposure, viral infection and the particular viral responsible for the viral infection or treatment or infection of a viral antigen, kind of concurrent treatment, complications from the viral exposure, viral infection or exposure or other health-related problems. Other therapeutic regimens or agents can be used in conjunction with the methods and compositions, proteins or polypeptides of the present invention. For example, the administration of the compositions and proteins can be accompanied by other viral therapeutics or use of agents to treat the symptoms of a condition associated with or consequent to exposure to the virus, and the antigen, or viral infection, for example. Adjustment and manipulation of established dosages (e.g., frequency and duration) are well within the ability of those skilled in the art.

In an embodiment, the subject (e.g., a human) can be administered the compositions, proteins and fusion proteins of the invention in at least one dose selected from the group consisting of about a 40.0 µg dose, about a 35.0 µg dose, about a 30.0 µg dose, about a 25.0 µg dose, about a 20.0 µg dose, about a 16.0 µg dose, about a 15.0 µg dose, about a 10.0 µg dose, about a 5.0 µg dose, about a 3.0 µg dose, about a 2.0 µg dose, about a 2.5 µg dose, about a 1.0 µg dose, about a 1.5 µg dose, about a 0.5 µg dose, about a 0.3 µg dose, about a 0.25 µg dose, about a 0.1 µg dose, about a 0.05 µg dose, about a 0.025 µg dose and about a 0.01 µg dose.

The composition and/or dose of the compositions, proteins and fusion proteins can be administered to the human in a single dose or in multiple doses, such as at least two doses. When multiple doses are administered to the subject, a second or dose in addition to the initial dose can be administered days (e.g., 1, 2, 3, 4, 5, 6 or 7), weeks (e.g., 1, 2, 3, 4, 5, 6, 7, 8, 9, 10), months (e.g., 1, 2, 3, 4, 5, 6, 7, 8, 9, 10) or years (e.g., 1, 2, 3, 4, 5, 6, 7, 8, 9, 10) after the initial dose. For example, a second dose of the composition can be administered about 7 days, about 14 days or about 28 days following administration of a first dose.

The compositions and methods of employing the compositions of the invention can further include a carrier protein. The carrier protein can be at least one member selected from the group consisting of a tetanus toxoid, a *Vibrio cholerae* toxoid, a diphtheria toxoid, a cross-reactive mutant of diphtheria toxoid, a *E. coli* B subunit of a heat labile enterotoxin, a tobacco mosaic virus coat protein, a rabies virus envelope protein, a rabies virus envelope glycoprotein, a thyroglobulin, a heat shock protein 60, a keyhole limpet hemocyanin and an early secreted antigen tuberculosis-6.

"Carrier," as used herein, refers to a molecule (e.g., protein, peptide) that can enhance stimulation of a protective immune response. Carriers can be physically attached (e.g., linked by recombinant technology, peptide synthesis, chemical conjugation or chemical reaction) to a composition or admixed with the composition.

Carriers for use in the methods and compositions described herein can include, for example, at least one member selected from the group consisting of Tetanus toxoid (TT), *Vibrio cholerae* toxoid, Diphtheria toxoid (DT), a cross-reactive mutant (CRM) of diphtheria toxoid, *E. coli* enterotoxin, *E. coli* B subunit of heat labile enterotoxin (LTB), Tobacco mosaic virus (TMV) coat protein, protein Rabies virus (RV) envelope protein (glycoprotein), thyroglobulin (Thy), heat shock protein HSP 60 Kda, Keyhole limpet hemocyamin (KLH), an early secreted antigen tuberculosis-6 (ESAT-6), exotoxin A, choleragenoid, hepatitis B core antigen, and the outer membrane protein complex of N. meningiditis (OMPC) (see, for example, Schneerson, R., et al., *Prog Clin Biol Res* 47:77-94 (1980); Schneerson, R., et al., *J Exp Med* 152:361-76 (1980); Chu, C., et al., *Infect Immun* 40: 245-56 (1983); Anderson, P., *Infect Immun* 39:233-238 (1983); Anderson, P., et al., *J Clin Invest* 76:52-59 (1985); Que, J. U., et al. *Infect Immun* 56:2645-9 (1988); Que, J. U., et al. *Infect Immun* 56:2645-9 (1988); Murray, K., et al., *Biol Chem* 380:277-283 (1999); Fingerut, E., et al., *Vet Immunol Immunopathol* 112: 253-263 (2006); and Granoff, D. M., et al., *Vaccine* 11:Suppl 1:S46-51 (1993)).

Exemplary carrier proteins for use in the methods and compositions described herein can include at least one member selected from the group consisting of cross-reactive mutant (CRM) of diphtheria toxin (SEQ ID NO: 41), coat protein of Tobacco mosaic virus (TMV) coat protein (SEQ ID. NO: 42), coat protein of alfalfa mosaic virus (AMV) (SEQ ID NO: 43), coat protein of Potato virus X (SEQ ID NO: 44), Porins from *Neisseria* sp, such as class I outer membrane protein of *Neisseria meningitides* (SEQ ID NO: 45), Major fimbrial subunit protein type I (Fimbrillin) (SEQ ID NO: 46), *Mycoplasma fermentans* macrophage activating lipopeptide (MALP-2) (SEQ ID NO: 47), and p19 protein of *Mycobacterium tuberculosis* (SEQ ID NO: 48).

The compositions, proteins and fusion proteins of the invention can further include at least one adjuvant. Adjuvants contain agents that can enhance the immune response against substances that are poorly immunogenic on their own (see, for example, Immunology Methods Manual, vol. 2, I. Lefkovits, ed., Academic Press, San Diego, Calif., 1997, ch. 13). Immunology Methods Manual is available as a four volume set, (Product Code Z37,435-0); on CD-ROM, (Product Code Z37,436-9); or both, (Product Code Z37,437-7). Adjuvants can be, for example, mixtures of natural or synthetic compounds that, when administered with compositions of the invention, such as proteins that stimulate a protective immune response made by the methods described herein, further enhance the immune response to the protein. Compositions that further include adjuvants may further increase the protective immune response stimulated by compositions of the invention by, for example, stimulating a cellular and/or a humoral response (i.e., protection from disease versus antibody production). Adjuvants can act by enhancing protein uptake and localization, extend or prolong protein release, macrophage activation, and T and B cell stimulation. Adjuvants for use in the methods and compositions described herein can be mineral salts, oil emulsions, mycobacterial products, saponins, synthetic products and cytokines Adjuvants can be physically attached (e.g., linked by recombinant technology, by peptide synthesis or chemical reaction) to a composition described herein or admixed with the compositions described herein.

The teachings of all patents, published applications and references cited herein are incorporated by reference in their entirety.

A description of example embodiments of the invention follows.

EXEMPLIFICATION

Example 1

H5 HA Globular Head Vaccines Utilizing R3 and 2XR3 Forms of Flagellin Provide Superior Efficacy and Improved Immunogenicity to Reactogenicity Ratios Materials and Methods
Vaccine Production
Cloning of recombinant HA genes. STF2.HA1-2 (VN):
For expression of recombinant hemagglutinin (HA) in *E. coli*, the codon optimized synthetic genes of the HA globular head domain of influenza A/Vietnam/1203/04 were fused directly to the C-terminus of the full-length sequence of *Salmonella typhimurium* fljB (flagellin phase 2), STF2 (SEQ ID NO: 447) (DNA2.0 Inc., Menlo Park, Calif.) to yield (SEQ ID NO: 451) or used to replace either the domain 3 STF2 (aa191-aa292, (SEQ ID NO: 447)) to yield (SEQ ID NO: 452) or domain 0 of STF2 (aa1-aa46 and aa465-aa506, HA1-2 fused to aa464 of SEQ ID NO: 447) to yield (SEQ ID NO: 453). For the C-terminal fusion construct (SEQ ID NO: 451 and 477), the last amino acid of flagellin, R506, was mutated to A506 to reduce proteolytic breakdown. The resulting constructs were cloned into the pET24a vectors. The plasmids were used to transform BLR3 (DE3) cells to generate working cell banks (Novagen, San Diego, Calif.).
STF2R3.HA1-2 (VN) (SEQ ID NO: 452 and 478).

To generate STF2R3.HA1-2 VN, a two-step PCR reaction was used to replace D3 domain of STF2 with HA1-2 (VN). In the first step, DNA from pET24a-STF2.HA1-2 (VN) (SEQ ID NO: 477) was used as DNA template, YZ015, YZ123 and YZ124, YZ140 were used as primers to amplify STF2 N-terminal and C-terminal respectively, YZ122 and YZ125 primers were used to amplify HA1-2 (VN). In the second step, gel purified STF2 and HA1-2 (VN) fragments were used as DNA templates, YZ015 and YZ140 were used as primers for the $2^{nd}$-step overlapping PCR reaction. The final PCR product was digested with NdeI and XhoI, gel purified and ligated by compatible ends to pET24a to generate the STF2R3.HA1-2 VN construct (SEQ ID NO: 478).
STF2R0.HA1-2 (VN) (SEQ ID NO: 453 and 479):

For construction of the STF2R0.HA1-2 (VN) gene (SEQ ID NO: 479) the hemagglutinin (HA) globular head domain of Influenza A/Viet Nam/1203/2004 was used to replace the domain D0 of *Salmonella typhimurium* fljB (flagellin phase 2). Two-step PCR was used to remove Domain D0 of STF2.HA1-2 (VN). In the first step, DNA from pET24a-STF2.HA1-2 VN (SEQ ID NO: 477) was used as a DNA template, and primers were used to amplify a STF2 fragment without domain 0 and the HA1-2 (VN) fragment respectively. In the second step, the two PCR fragments from the $1^{st}$-step were gel purified and were used as DNA templates. Primers for the $2^{nd}$-step were employed that overlapped in PCR reaction. The final PCR product was digested with NdeI and XhoI, gel purified and ligated by compatible ends to pET24a to generate the STF2R0.HA1-2 VN construct.
STF2R3.2xHA1-2 (VN) (SEQ ID NO: 455 and 480).

For construction of the STF2R3.2xHA1-2 VN gene (SEQ ID NO: 455), DNA from pET24a-STF2.HA1-2 (VN) (SEQ ID NO: 477) was digested with NdeI and MfeI, the 6.6 kb fragment was purified and used as the vector. DNA from pET24a-STF2R3.HA1-2 (VN) (SEQ ID NO: 478) was digested with NdeI and MfeI, the 1.4 kb fragment was purified as the insert. Vector and insert DNA were ligated to generate the STF2R3.2xHA1-2 VN construct (SEQ ID NO: 480).

Expression and Purification of HA Globular Head-Flagellin Fusion Proteins:

Fusion proteins that include Toll-like Receptor 5 agonists (also referred to herein as "flagellin fusion proteins") were manufactured utilizing a fed-batch fermentation process in *E. coli*. After complete exhaustion of the available glucose during the batch phase, four liters of enriched synthetic feed media was pumped at a controlled rate over an additional 10.5 hrs (for a total process time was 30.3 hrs). Expressions of the target protein were induced with 2.1 mM IPTG (final concentration). Cells were pelleted by centrifugation and cell paste was stored at −20° C. Cell paste was thawed and diluted to 15% solids in 50 mM Tris 25 mM NaCl (pH 8). The suspension was homogenized three times under 12 k PSI. STF2.HA1-2 (SEQ ID NO: 451) and STF2R0.HA1-2 (SEQ ID NO: 453) were located in both supernatant and pellet. Only supernatant was processed.

The majority of STF2R3.HA1-2 (SEQ ID NO: 452) was found in the pellet. Only the inclusion body was processed. For the supernatant process, protein fractions containing the fusion protein were precipitated by either 10% polyethylene glycol (PEG) or by 4M $(NH_4)_2SO_4$. The pellets were dissolved in 8 M urea at pH 4 to solubilize the target protein. Soluble proteins were extracted in the supernatant phase by centrifugation. Supernatants were bound to a CEX column (Tosoh SP650M) in 6M Urea, low salt. The target proteins were eluted under NaCl step elution conditions. The collected proteins were refolded by rapid dilution using 20 mM Tris, 0.5M Urea, 0.1M Trehalose, 2 mM $CaCl_2$, 3 mM Cysteine, 0.3 mM Cystine, 1 mM EDTA, 0.1% PS-80, pH 8.0 with constant stirring overnight.

The refolded proteins were concentrated to 1 liter and the buffer exchanged using 50 mM Tris, 0.05% PS80, 0.1 M Trehalose (pH 8). Q anion exchange chromatography was performed to remove remaining impurities. High protein containing, Q eluate peak fractions were selected for further processing. Size exclusion chromatography was performed as a final purification step to isolate the purified monomeric form of the target proteins. For the pellet process, the inclusion body was washed with 1% Triton X-100 and solubilized with 8M urea. The protein was refolded by the rapid dilution using the same condition. Further purification follows the same steps as the supernatant process. Final bulk protein was stored at −70° C. as 1 mL aliquots. Residual endotoxin was assayed by using standard Chromogenic Limulus Amebocyte Lysate assay (Cambrex, Walkersville, Md.) as directed by the manufacturer. For the 6×His tagged baculaovirus produced proteins, the metal chelating column was employed. Protein was loaded to a Ni-NTA column equilibrated in 20 mM Tris, pH 8, 0.5 M NaCl and eluted in a gradient of 0-0.5 M imidazole. The target protein was further purified by size exclusion column (10/300 GL, GE/Amersham). The peak fractions were pooled, concentrated and dialyzed against 1×PBS. Aliquoted protein solution was stored at −80° C.

Characterization of Flagellin-HA Globular Head Fusion Proteins

Western Blot:

*E. coli* expressed, purified STF2.HA1-2 (VN) (SEQ ID NO: 451) fusion protein was resolved by SDS-PAGE. Western blotting was performed using a monoclonal antibody specific for flagellin (6H11; Inotek, Lexington, Mass.) or convalescent ferret immune serum raised against influenza A/Vietnam/1203/2004 (VN04) virus (provided by the U.S. Centers for Disease Control and Prevention, Atlanta, Ga.).

TLR5 Bioassay:

TLR5-specific activity of fusion proteins was evaluated by measuring induction of IL-8 production by HEK 293 cells (ATCC). Cells were cultured in 96-well microtiter plates (Costar) at a seeding density of about 3 to about $5\times10^4$ cells in 100 μl/well in DMEM medium supplemented with 10% FCS and antibiotics. The next day, cells were treated for 5 hours with serial dilutions of test proteins starting at about 5 μg/ml. At the completion of the assay, supernatants were harvested and IL-8 expression was evaluated by ELISA (Invitrogen, Carlsbad, Calif.). $OD_{450}$ was measured on a microplate spectrophotometer (Molecular Devices-MDS, Sunnyvale, Calif.).

Assessment of Immunogenicity and Efficacy

Animals:

All animal studies were approved by the Institutional Animal Care and Use Committee and were carried out according to NIH guidelines. BALB/c mice were purchased from Harlan (Indianapolis, Ind.). Vaccination and implantation of transponders for telemetric temperature recording was carried out in the animal biosafety level (ABSL)-2 facility. H5N1 virus infection was performed in the ABSL-4 facility.

Vaccination:

Six-week-old female BALB/c mice (Harlan) were vaccinated subcutaneously (s.c.) with two or three doses of vaccine (day −28, −14) or (−42, −28, −14) in 40 μl of vehicle (DPBS). The animals were bled 7 or 12 days following the last vaccination. Seroconversion was then evaluated via HAI assay (see Hemagglutination inhibition). For efficacy studies, H5N1 infection was subsequently performed (see Challenge). Clinical observations of disease development and mortality were monitored daily during the pre-vaccination period, as follows: day −28 to −1 (two vaccine dose trials) or day −42 to −1 (three vaccine dose trials). The weights were recorded periodically.

Challenge:

Prior to virus infection, anesthesia was performed using 5% isofluorane. The mice were then infected intranasally (i.n.) with influenza A/Vietnam/1203/04 at a dose determined in units of about 50% tissue culture infectious dose ($TCID_{50}$) per animal of H5N1 in 40 μl of PBS (day 0). Back-titration of the inoculum was performed to determine the delivered dose (see $TCID_{50}$ assay) provided in the figures. Clinical observations of disease development and mortality were monitored daily during the pre-vaccination (see Vaccination) or post-challenge period (day 0 to day +20-21) and weights were recorded at times indicated in figure legends. All animals that developed paralysis and were not able to reach feeders or water bottles were euthanized. Statistical analysis of survival for all groups over the indicated period was performed using logrank test at a significant level of $\alpha<0.05$ in GraphPad® Prism (San Diego, Calif.). For pairwise comparison of the survival of treated and untreated (or mock-treated) groups Fisher's Exact Test was performed at a significant level of $\alpha<0.05$ in GraphPad® Prism. The p-values (logrank and Fisher's Exact Test) are provided in figure legend. The level of infectious virus in organs was evaluated following preparation of a 10% homogenate (see $TCID_{50}$ assay).

Clinical Disease Definitions:

Standardized data reporting by uniformly trained veterinary technicians was performed daily. Outcomes monitored were death, and the development of encephalitis or paralysis using the following definitions: encephalitis, development of discoordination, ataxia or transient seizures with retention of the ability to drink and feed; paralysis, hind limb (hemiplegic) or quadriplegic paralysis with the inability to reach the feeder or water bottle.

H5-ELISA:

ELISA plates were coated with each of the HA proteins at the indicated concentrations in PBS overnight at 4° C., blocked with 200-300 µl/well of Assay Diluent Buffer (ADB; BD Pharmingen, San Diego, Calif.) for 2-3 hours at 23-27° C. After incubation with the indicated detection antibodies, HRP-labeled goat anti-mouse antibody (Jackson Immunochemical, West Grove, Pa.) diluted in ADB was added and the plates were incubated at 23-27° C. for 1-2 hours. All washes between reagent addition steps were performed 3 times with 1×PBS/0.05% Tween-20. After adding TMB Ultra substrate (Pierce, Rockford, Ill.) and monitoring color development, the reaction was stopped with 1M $H_2SO4$ and $OD_{450}$ was measured on a microplate spectrophotometer.

Hemagglutination Inhibition (HAI) Test:

HI antibody titer against influenza A/Vietnam/1203/04 (VN04) was measured by a standard method at BSL3 facility (Southern Research Institute; Birmingham, Ala.), as described herein. Antigen was prepared and the total HA units of the stock was determined as described for hemagglutination assay (Bright, R. A., et al., *PLOSI* 3:1501 (2008)). Sera were treated with receptor destroying enzyme, diluted, and incubated with 4 HA units (HAU) of influenza A/Vietnam/1203/04 virus in about 25 µl for about 45 minutes at room temperature. Horse red blood cells (1%) were added (50 µl/well), mixed briefly, and incubated for 1 hr at room temperature. The HAI titers of serum samples are reported as the reciprocal of the highest dilution at which hemagglutination was completely inhibited.

Reactogenicity Studies

Animals: Studies with female and male New Zealand White rabbits were performed at Covance Research Products (Denver, Pa.).

Reactogenicity Evaluations: Rabbits (6/group) were immunized intramuscularly (i.m.) on days 0 and 21. Sera were harvested 1 day post the priming immunization for CRP measurements (CRP ELISA kit, Immunology Consultants Laboratory, Newberg, Oreg.). Food consumption was measured from day 0 to day 1.

Results and Discussion

Design of STF2.HA1-2 (VN) (SEQ ID NO: 451):

The HA globular head domain contains the cell surface receptor binding site and the majority of the neutralizing antibody epitopes (Takeda et al., *Annu Rev Immunol* 21:335-76(2003); Ben-Yedidia et al., *Expert Rev Vaccines* 6(6):939-48) (2007)). A subunit vaccine which encompasses the neutralizing epitopes of the A/Vietnam/1203/2004 HA globular head and also contained the structural elements necessary for spontaneous and efficient folding to correctly display these epitopes after recombinant protein expression in *E. coli* was designed. The domain boundary was placed between residues G62 and E284 to generate the HA subunit designated as HA1-2 VN (SEQ ID NO: 481 and 482). The HA1-2 subunit was further genetically fused to the C-terminus of *Salmonella typhimurium* flagellin type 2 (STF2) to form STF2.HA1-2 (VN) (SEQ ID NO: 451 and 477). FIG. 1 shows a ribbon diagram of a C-terminal fusion of an HA globular head domain fused to the C terminus of flagellin.

Efficacy Associated with STF2.HA1-2 (VN) (SEQ ID NO: 451) Given in a Two-Dose Regimen:

The efficacy of this vaccine was assessed in a mouse lethal challenge model. For these studies, mice were challenged intranasally with about a $10 \times LD_{90}$ of the highly pathogenic A/Vietnam/1203/2004 (VN04) strain. Survival and disease development were monitored for 20-21 days post-challenge. Previous H5N1-challenge studies in mice indicate that symptomatic mice developed hypothermia at approximately 8 days post-infection, hence periodic telemetric monitoring was also performed in these studies to provide an indication of disease development.

In the first efficacy study carried out, groups of 15 BALB/c mice were immunized twice at a two week interval with 1, 3, or 10 µg of the STF2.HA1-2 (VN) (SEQ ID NO: 451) vaccine delivered s.c. Two weeks post the booster dose mice were challenged with the VN04 virus. A statistically significant (logrank test, p<0.0001), dose-dependent decrease in severe disease and death relative to the placebo control group was observed, with survival rates of 18, 40, and 73% of mice respectively, for the 1, 3 and 10 µg dose groups. The control animals (mock vaccinated and unvaccinated) developed severe disease and subsequently succumbed to the challenge (Table 4, study 1).

The clear relationship between dose level and efficacy from this first study suggested that efficacy could be further enhanced with doses of STF2.HA1-2 (VN) (SEQ ID NO: 451) greater than about 10 µg. The potential for augmenting the protection by further increasing the vaccine dose level was therefore evaluated. However, dosages of up to 30 µg of STF2.HA1-2 (VN) (SEQ ID NO: 451) did not seem to improve the overall survival.

The potential for augmenting the protection was further evaluated using three immunizations of the vaccine (Table 4, study 2). In this study, dose of 1, 3, and 10 µg of STF2.HA1-2 (VN) (SEQ ID NO: 451) were delivered at 42, 28 and 14 days pre-challenge. Higher survival rates for all dose groups were observed with 87%, 93%, and 100% of the mice surviving the challenge. None of the animals in the placebo (mock vaccinated) control group survived the challenge and the median survival was 7 days.

Study 2 was repeated with the additional evaluation of viral titers in the organs of five randomly pre-selected animals per group. High survival rates of 87%, 80%, and 93% were observed. The control group succumbed to the disease in average 6 days. (Table 4, study 3).

TABLE 4

Survival Rates following 2 or 3 immunizations of STF2.HA1-2 VN (SEQ ID NO: 451)

| Dose Group | Study 1 % Survival | Study 2 % Survival | Study 3 % Survival |
|---|---|---|---|
| 10 µg (N = 15) | 73 | 100 | 93 |
| 3 µg (N = 15) | 40 | 93 | 87 |
| 1 µg (N = 15) | 18 | 87 | 80 |
| Placebo (N = 30) | 0 | 0 | 0 |

In mice, the broader tissue tropism for HPAI viruses has been shown to be associated with a polybasic cleavage site which allows the virus to be easily cleaved by proteases at extra-pulmonary sites and to specific amino acid substitutions in the PB2 protein (Hatta et al., *Science* 7:293(5536) (2001): 1840-2; Katz et al., *J Virol* 74 (22):10807-10 (2000)). Although the tissue tropism and pathogenesis of these viruses is not as well defined in humans, there are reports of systemic infection in humans (Beigel et al., *N Engl J Med* 35:1374-85 (2005)). It was therefore relevant to study the virus loads in vaccinated animals in both lung and brain tissue. In study 2, organs were collected from randomly pre-selected animals (N=5) on day +6 and evaluated for levels of infectious virus. Individual values as well as the group averages/standard deviation are presented in Table 5.

TABLE 5

Virus loads in brain and lung days 6 post-challenge

| | Brain | | | | Lung | | | |
|---|---|---|---|---|---|---|---|---|
| | Average | | Undetectable | | Average | | Undetectable | |
| Group | Titer | SD | Proportion | Percent | Titer | SD | Proportion | Percent |
| 10 µg (N = 5) | 0.00E+00 | 0.00E+00 | 5/5 | 100 | 3.00E+04 | 6.71E+04 | 4/5 | 80 |
| 3 µg (N = 5) | 0.00E+00 | 0.00E+00 | 5/5 | 100 | 2.00E+04 | 4.47E+04 | 4/5 | 80 |
| 1 µg (N = 5) | 0.00E+00 | 0.00E+00 | 5/5 | 100 | 2.20E+05 | 4.38E+05 | 3/5 | 60 |
| Placebo (N = 5) | 8.10E+04 | 6.50E+04 | 0/5 | 0 | 3.53+07 | 6.43E+07 | 0/5 | 0 |

A difference of at least about five $\log_{10}$ in the average brain titer was measured between the vaccinated and placebo groups, irrespective of the vaccine dose (1, 3 or 10 µg). Virus was below the limit of detection (about less than $<1\times10^4$ $TCID_{50}$/g of tissue) in the brains of all vaccinated animals, whereas for the placebo group, the average titer was about 4.9 (±4.8) $\log_{10}$ $TCID_{50}$/g. In the lungs, a titer difference of 2.2-3.2 $\log_{10}$ was detected; for vaccinated animals the average titer was between about 4.3 and about 5.3 (±4.7-5.6) $\log_{10}$ $TCID_{50}$/g, whereas the placebo average was 7.6 (±7.8) $\log_{10}$ $TCID_{50}$/g. Virus was undetectable in 60% of the lungs of those vaccinated with about 1 µg and about 80% of those vaccinated with 3 or 10 µg of STF2.HA1-2 (VN). In contrast, virus could be detected in 100% of the lungs and brains of the placebo animals. Based on the 3 µg dose group results the level of protection was comparable between the first and second 3-dose trials.

Thus, the STF2.HA1-2 (VN) (SEQ ID NO: 451) vaccine, when used in a 3-dose regimen, provided significant protection, which was consistent, as demonstrated by survival rates of ≥80% in two independent studies and reduced the virus titer in the brain and lungs.

R3 and 2xR3 Forms of Flagellin Improve the Antigenicity and Immunogenicity of VN Globular Head Vaccines Design of Alternative Constructs:

Data from phase I clinical trials of inactivated virus vaccines against H9N2, H5N3 and H5N1 viruses indicate that vaccines against avian influenza viruses may not be optimally immunogenic and may require multiple doses and/or the inclusion of an adjuvant to induce a protective immune response (Treanor, et al., *New Eng. J. Med.* 354:1343-1351 (2006)). The poor immunopotency of these vaccines has largely been attributed to the fact that people are immunologically naïve to the HA antigens associated with the avian subtypes. Additional contributing factors may be that the avian HA antigens are actually less antigenic than the HAs of the H1, H3 or B subtypes. Poor neutralizing titers are elicited by sub-lethal infection with avian isolates and immunogenicity studies comparing the potency of avian and human HAs in naïve animal models.

Similar observations regarding the relative antigenicity of H1 and H5 vaccines has been made. For example, the efficacy studies described above, the fact that three immunizations of STF2.HA1-2 (VN) (SEQ ID NO: 451) were required to achieve 100% protection suggested that the H5 globular head was not optimally presented to the immune system when fused to the C-terminus of flagellin. Crystallographic and high resolution electron cryomicroscopic models show that the N and C-terminal peptides of flagellin come together to form a two-stranded coiled-coil that is referred to as the D0 domain (Yonekura et al., *Nature* 424:643-50 (2003)). When forming flagella, the D0 domain is highly structured and constitutes the central tube of the flagella while the adjacent D1 domain lines up to form the outer tube. The coiled-coil structure of the D0 domain is well maintained through the extensive inter-molecular interactions among adjacent D0 domains and D0 and D1 domains. It is possible that without these inter-molecular restrictions, the D0 domain structure is not stable.

In solution, the D0 domain of the monomeric flagellin is unstructured, leaving roughly 65 residues of N-terminus and 45 residues at the C-terminus as extended flexible peptide (Vonderviszt et al. *J Mol Biol* 209:127-33 (1989)). The flexibility of the peptide preceding to the fused HA head may allow for intra- or inter-molecular interactions that hinder the optimal antigenic presentation of HA globular head. The extent of these inter- or intra-molecular interactions could differ among HA molecules depending on the surface chemistry of the globular head.

Figure 2:
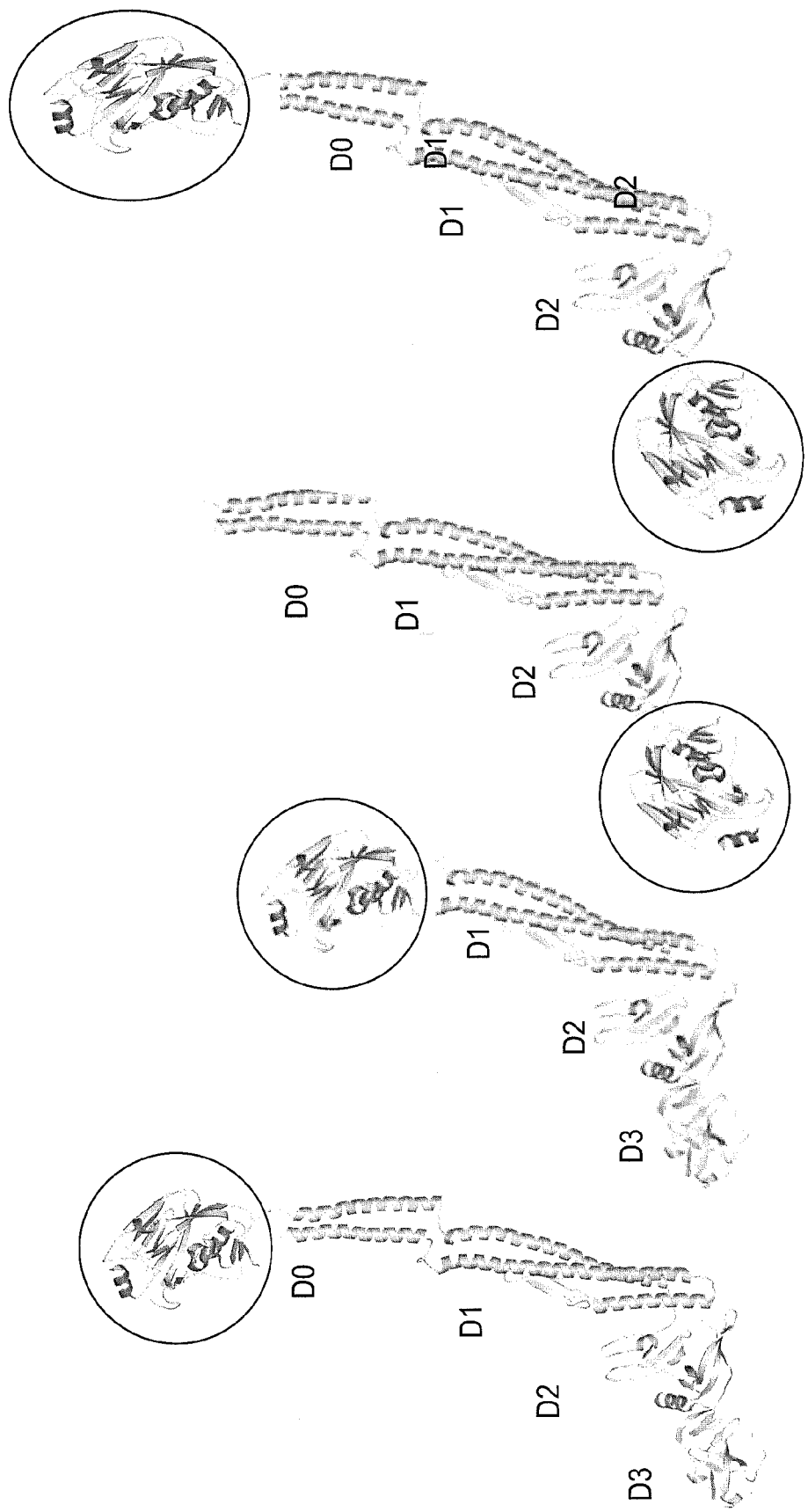
FIG. 2 depicts alternative placements of the HA globular head. The globular head is circled in each of the flagellin constructs.

Additional Viet Nam constructs were designed. With the first design, the flexible D0 domain was replaced with the HA globular head to generate STF2R0.HA1-2 VN (SEQ ID NO: 453). With the second design, both ends of the HA globular head domain were tethered to flagellin by replacing the D3 domain of the flagellin molecule with the globular head to generate STF2R3.HA1-2 VN (SEQ ID NO: 452) and with the third design both the D3 domain was replaced with the globular head and a globular head was placed on the C terminus of the D0 domain. FIG. 2 shows the ribbon diagrams with the alternative placements of the HA globular head.

Comparative Antigenicity of Alternative Constructs:

The relative antigenicity of the different alternative constructs was evaluated by ELISA. ELISA plates were coated with decreasing concentrations of the different Viet Nam protein preparations. Molar equivalents of the different proteins were controlled for.

Figure 3:
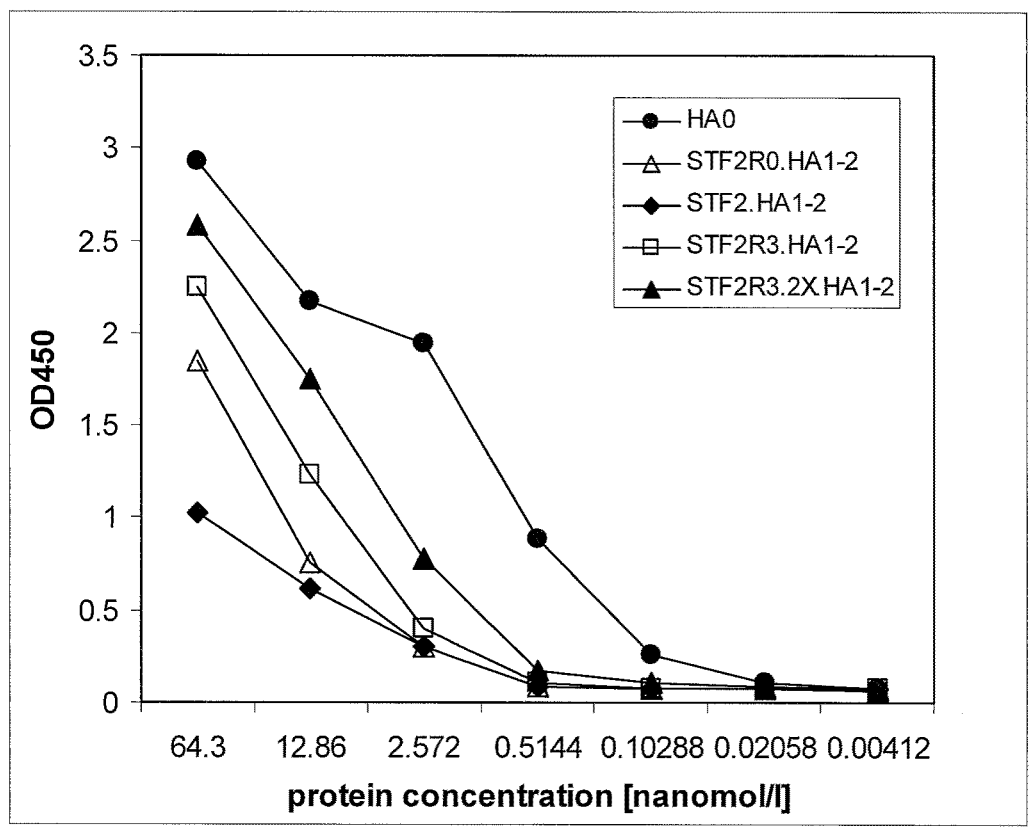
FIG. 3 depicts relative antigenicity of different Viet Nam (VN) constructs. ELISA plates were coated with the indicated molar concentrations of the different proteins. Plates were probed with ferret convalescent serum (1:1000). Mean absorbance for replicate wells are depicted.

HA0 (SEQ ID NO: 454), is a protein produced using the baculovirus expression system, and was included as a positive control. HA0 corresponds to the full ectodomain of the HA protein. The protein coated ELISA plates were probed with convalescent sera raised in ferrets and obtained from the CDC (Atlanta, Ga.). The results are shown in FIG. 3. The strongest reactivity was observed for the positive control construct, HA0 (SEQ ID NO: 454). The R3 (SEQ ID NO: 452) and the 2x.R3 (SEQ ID NO: 455) constructs reacted very strongly with the convalescent sera. Somewhat surprisingly, the STF2.HA1-2 (VN) (SEQ ID NO: 451) protein reacted relatively poorly with the convalescent sera as did the R0 (SEQ ID NO: 453) construct.

Figure 4:
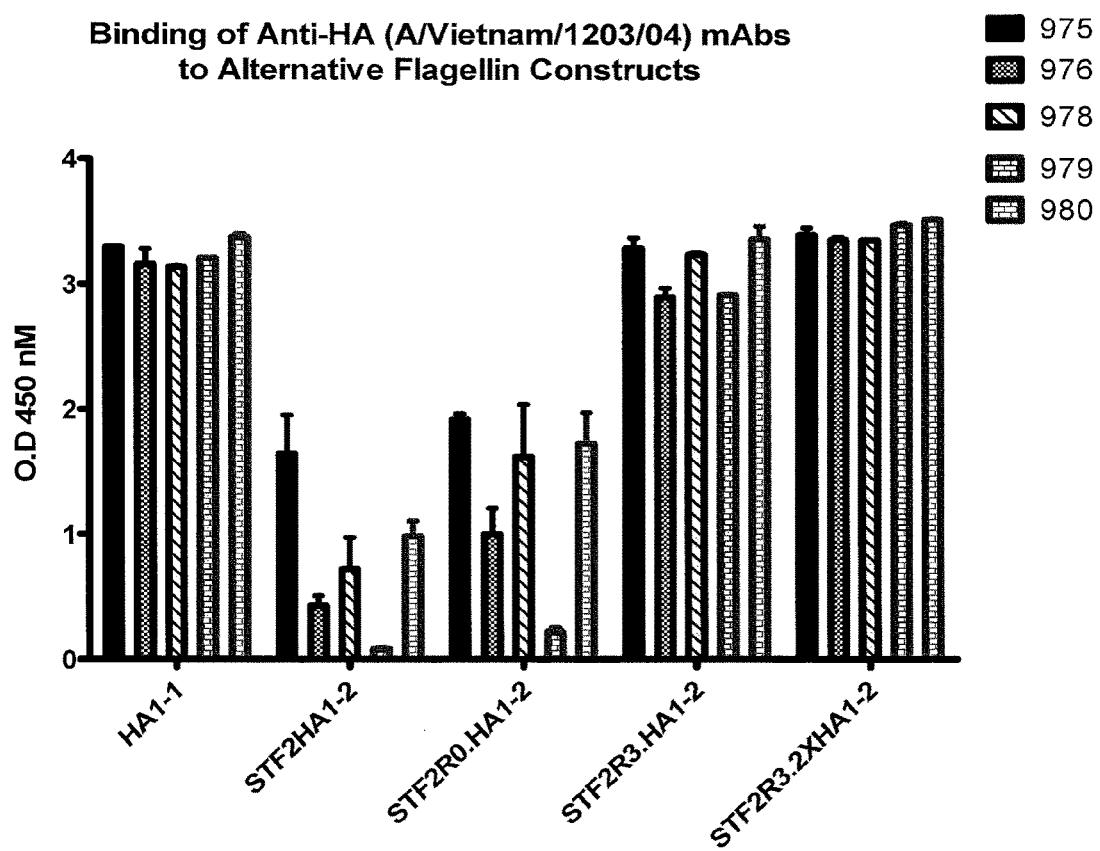
FIG. 4 depicts relative reactivity of monoclonal antibody against alternative VN constructs. ELISA plates were coated with about 4 µg/ml of each protein in duplicates overnight, blocked and incubated with a 1:5000 dilution of each of the monoclonal antibodies for 2 hours at room temperature (one antibody per plate), followed by a 30 minute incubation of a 1:10,000 dilution of HRP-goat anti-mouse IgG for 30 minutes and developed with TMB. Mean absorbance for replicate wells are depicted.

In a second series of experiments the different Viet Nam constructs were probed with a panel of five neutralizing monoclonal antibodies specific for epitopes located within the globular head domain of the Viet Nam HA (Rockland Immunochemicals, Inc., Gilbertsville, Pa.). The positive control in this experiment was baculovirus produced HA1-1 (SEQ ID NO: 456) protein. HA1-1 comprises the HA globular head and part of the HA stalk. When probed with the VN specific monoclonal antibodies, the reactivity of both the STF2.R3.2x.HA1-2 (SEQ ID NO: 455) and STF2R3.HA1-2 (VN) (SEQ ID NO: 452) constructs, was comparable to baculovirus produced HA1-1 (FIG. 3). By contrast, STF2R0.HA1-2 (VN) (SEQ ID NO: 453) and STF2.HA1-2 (VN) (SEQ ID NO: 451) reacted less well and in some instances very poorly with each of the five monoclonal antibodies tested (FIG. 4). These results are consistent with that HA globular head was better presented in the R3 (SEQ ID NO: 452) construct. None of the tested constructs interacted with mAb977 and that might be due to the absence of the specific epitope in these constructs.

Comparative TLR5 Activity of Alternative Constructs:

TLR5 bioactivity was assessed using an in vitro assay. Briefly, HEK 293 cells (ATCC) were cultured in 96-well microtiter plates (Costar) at a seeding density of about 3 to about $5 \times 10^4$ cells in 100 µl/well in DMEM medium supplemented with 10% FCS and antibiotics. The next day, cells were treated for 5 hours with serial dilutions of test proteins starting at 5 µg/ml. At the completion of the assay, supernatants were harvested and IL-8 expression was evaluated by ELISA (Invitrogen, Carlsbad, Calif.). $OD_{450}$ was measured on a microplate spectrophotometer (Molecular Devices-MDS, Sunnyvale, Calif.).

The C terminal fusion STF2.HA1-2 (VN) construct (SEQ ID NO: 451), STF2R3.HA1-2 (VN) (SEQ ID NO: 452) and the STF2R3.2x.HA1-2 VN constructs (SEQ ID NO: 455) induced strong IL-8 secretion in this assay, which is indicative of potent TLR5 activity (Table 6). However, STF2R0.HA1-2 (SEQ ID NO: 453) behaved poorly in this assay and consistent with previous reports indicates that at least a portion or the entire D0 domain of flagellin can significantly influence the TLR5 interaction. Table 6: TLR5 Activity of Alternative Flagellin VN HA Globular Head Proteins

| Protein | IL-8 (ng/mL) |
| --- | --- |
| STF2.HA1-2 VN | 2349 |
| STF2R3.HA1-2 VN | 2960 |
| STF2R3.2x.HA1-2 VN | 1713 |
| STF2R0.HA1-2 VN | 18 |

Figure 5:
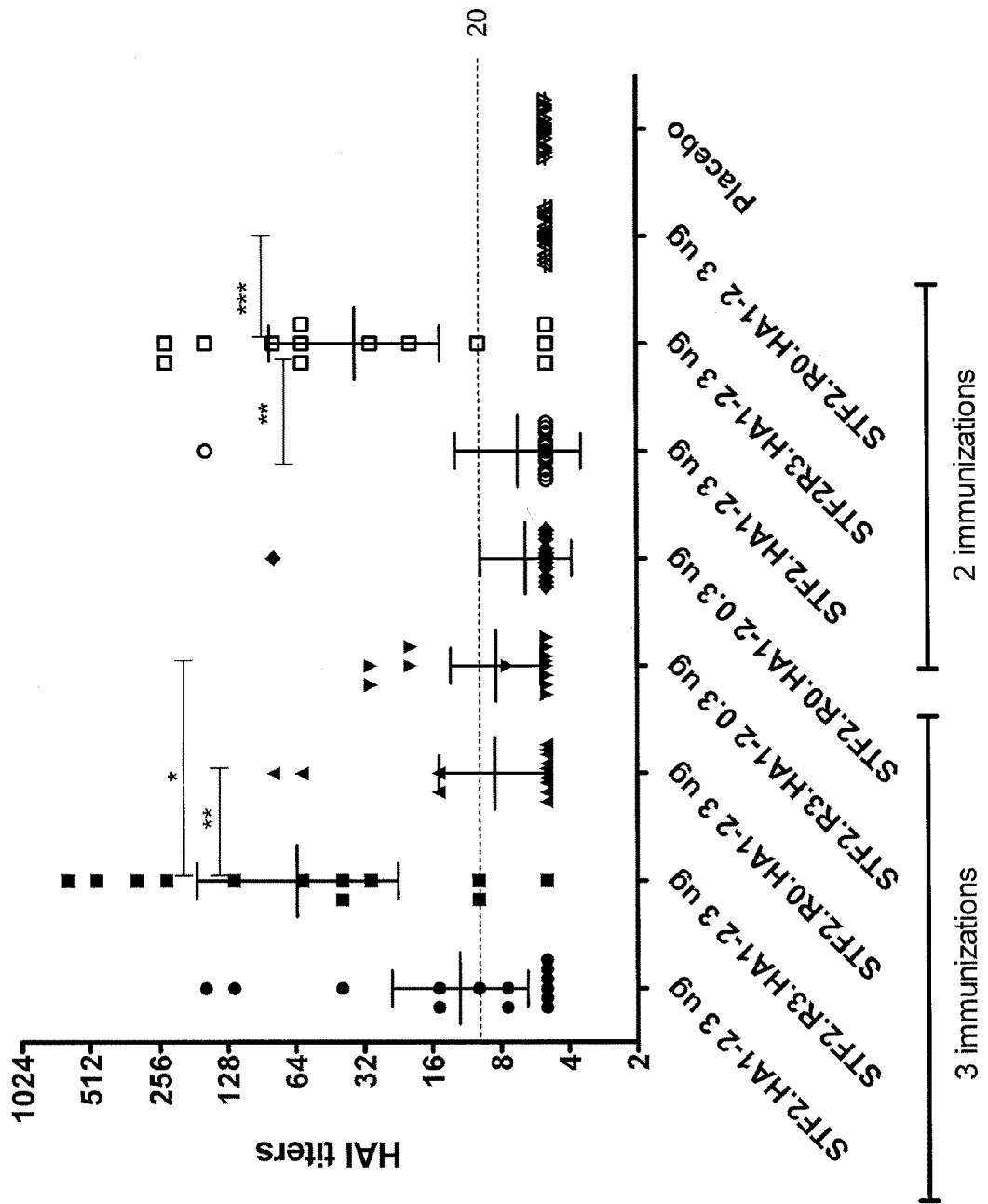
FIG. 5 depicts an induction of serum HAI antibodies in mice immunized with various VN constructs. BALB/c mice were immunized either three times (3×) at a 2-week interval or twice (2×) at a 3-week interval. Mouse serum samples (n=10-15) collected 12 days post the second ($2^{nd}$) or third ($3^{rd}$) boost were treated with RDE, heat-inactivated, and subjected to an HAI test with influenza A/Vietnam/1203/04 (H5N1) virus. The HAI titers were plotted individually with GMT (horizontal lines) and 95% CI (bars). Dashed line represents a 4-fold HAI titer over the baseline. Bracketed bars represent groups compared in a statistical analysis. *, p<0.05, significant in Kruskal-Wallis/Dunns tests; , p<0.01, very significant; *, p<0.001, extremely significant.

Comparative Efficacy of Two Versus Three Doses of STF2.HA1-2 (VN) (SEQ ID NO: 451), STF2R0.HA1-2 (VN) (SEQ ID NO: 453) or STF2R3.HA1-2 (VN) (SEQ ID NO: 452) in Mice:

In a head-to-head efficacy study, doses of 3 or 0.3 µg of STF2.HA1-2 (VN) (SEQ ID NO: 451), STF2R0.HA1-2 (VN) (SEQ ID NO: 453) or STF2R3.HA1-2 (VN) (SEQ ID NO: 452) were delivered either at days 42, 28 and 14 (2 week interval between doses) pre-challenge or days 42 and 21 (3 week interval between doses) pre-challenge. Serum samples were collected 12 days post the last boost, and subjected to a standard HAI test against A/Vietnam/1203/04 (FIG. 5). The STF2R0.HA1-2 (VN) (SEQ ID NO: 453) construct failed to elicit significant levels of serum HAI antibodies following either two or three immunizations. This is consistent with the low TLR5 activity of STF2R0.HA1-2 (VN) (SEQ ID NO: 453) as shown in Table 6. However, the R0 construct may be useful for certain compositions when a strong or robust TLR5 response may not be desired, as discussed herein. These would be compositions where the subject is either immunologically naïve or primed, little immunopotentiation is required and low reactogenicity is highly desired. In addition, as shown herein, immunogenicity that predicts a therapeutic window for use in humans (i.e., immunogenicity, low reactogenicity) may vary in an animal model, as shown herein.

STF2R3.HA1-2 (VN) (SEQ ID NO:452) elicited the highest HAI titers with GMTs of 63 and 35 following 3 and 2 immunizations of 3 µg, respectively. Significantly lower levels of HAI antibodies were elicited by 0.3 µg of STF2R3.HA1-2 (VN) (SEQ ID NO: 452) (GMT=8) as compared to 3 µg. With the two immunization regimen, STF2R3.HA1-2 (VN) (SEQ ID NO: 452) was the only immunogen that induced significant levels of HAI antibodies. HAI titers of pooled STF2R3.HA1-2 (VN) (SEQ ID NO: 452) samples were about 160, about 20, and about 80 for 3 immunization of 3 µg, 0.3 µg, and 2 immunizations of 3 µg, respectively. STF2.HA1-2 (VN) (SEQ ID NO: 451) induced intermediate levels of HAI antibodies.

Figure 10A:
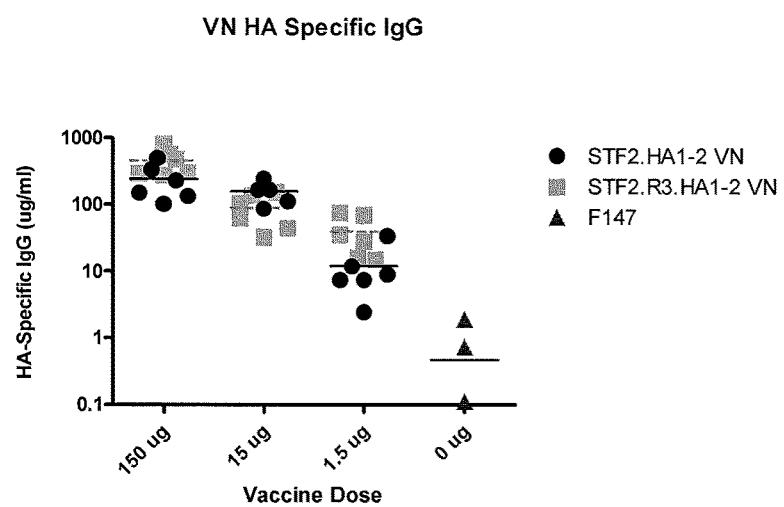
Figure 10B:
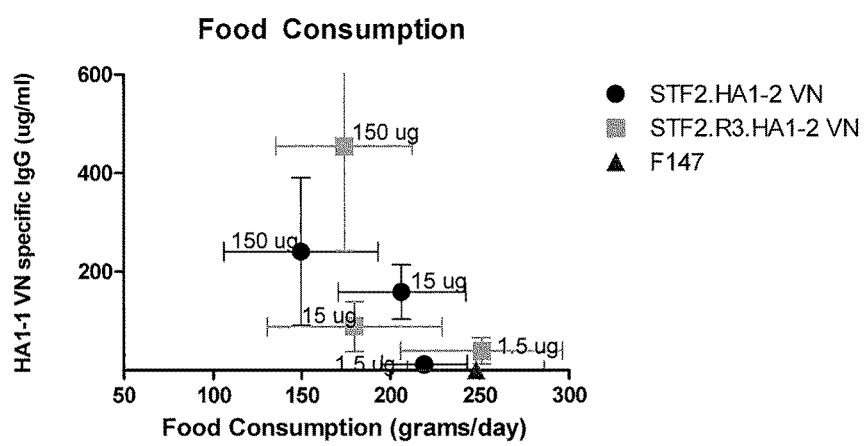
Figure 10C:
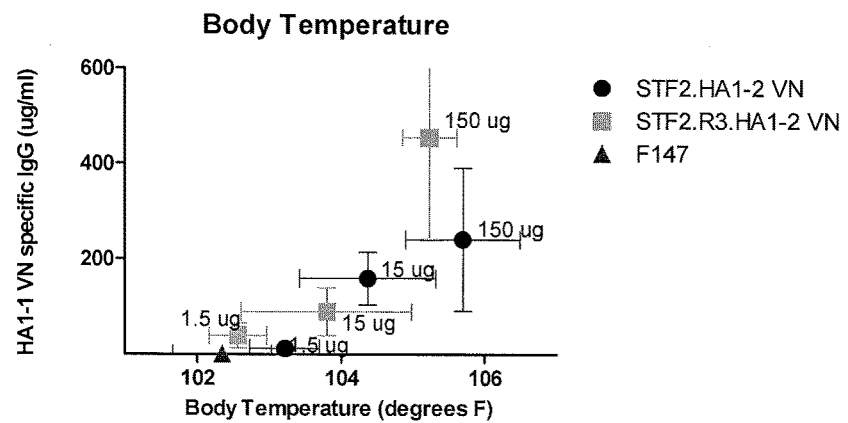
Figure 10D:
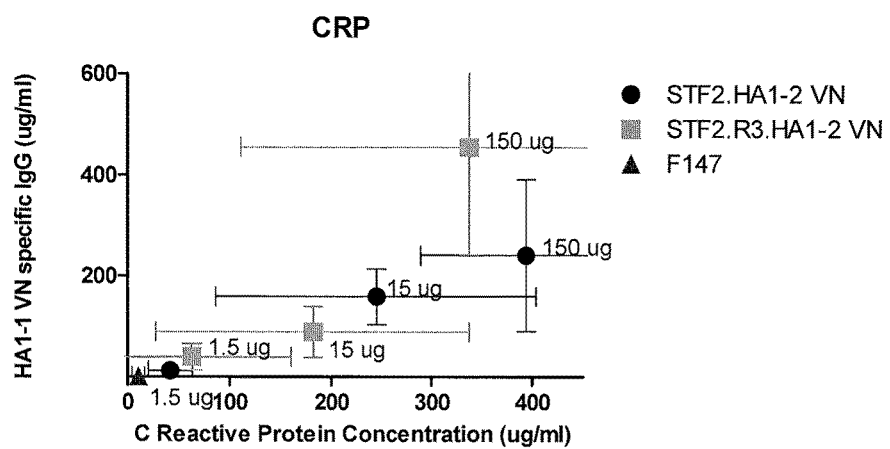
Figure 10E:
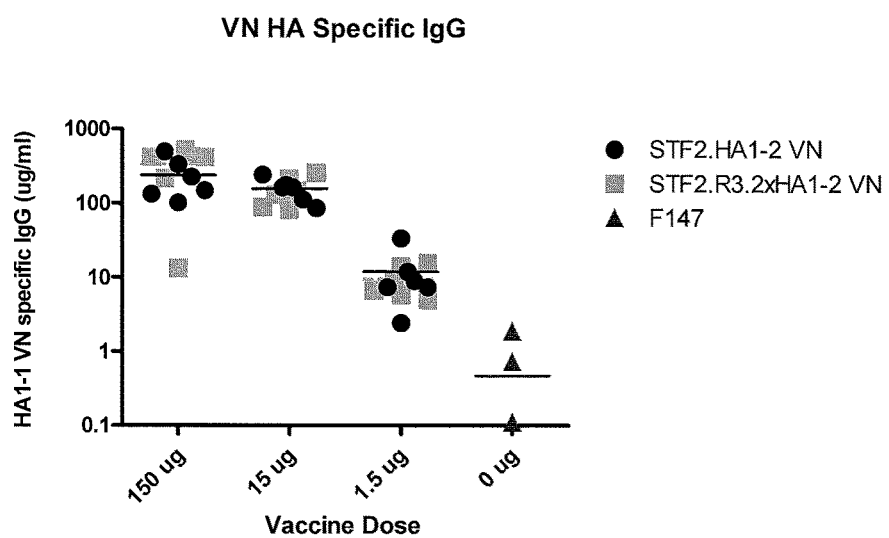
Figure 10F:
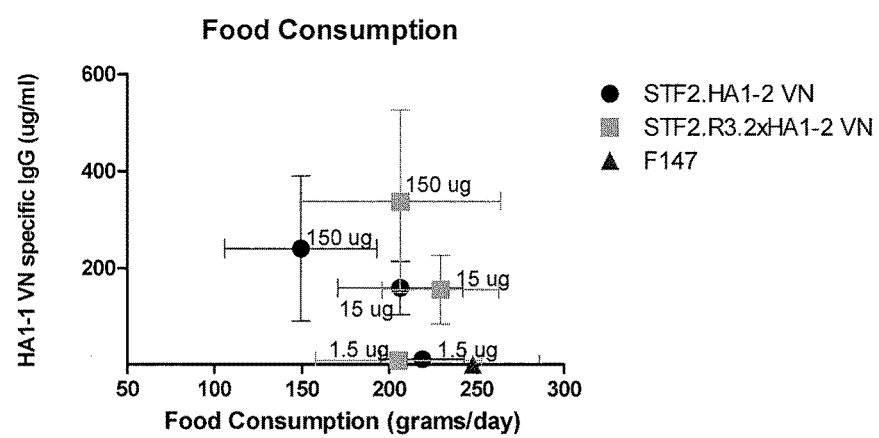

Two (3 immunizations) or three weeks (2 immunizations) post the last booster dose, mice were challenged intra-nasally with about $10 \times LD_{90}$ of the highly pathogenic A/Vietnam/1203/2004 strain. Survival and disease development were monitored for 20-21 days post-challenge (Table 7 and FIGS. 10A and 10B).

TABLE 7

Survival rates and weight loss following 3 or 2 doses of different globular head constructs

| Group & Dose | % Survival Day 5 | % Survival Day 7 | % Survival Day 9 |
| --- | --- | --- | --- |
| Three Dose Regimen | | | |
| STF2.HA1-2 (VN) 3 µg (N = 10) | 100 | 100 | 100 |
| STF2R3.HA1-2 (VN) 3 µg (N = 10) | 100 | 100 | 100 |
| STF2R0.HA1-2 (VN) 3 µg (N = 10) | 100 | 0 | 0 |
| STF2.HA1-2 (VN) 0.3 µg (N = 10) | 100 | 60 | 60 |
| STF2R3.HA1-2 (VN) 0.3 µg (N = 10) | 100 | 100 | 80 |
| STF2R0.HA1-2 (VN) 0.3 µg (N = 10) | 100 | 10 | 10 |
| Two Dose Regimen | | | |
| STF2.HA1-2 (VN) 3 µg (N = 10) | 100 | 30 | 30 |
| STF2R3.HA1-2 (VN) 3 µg (N = 10) | 100 | 100 | 100 |
| STF2R0.HA1-2 (VN) 3 µg (N = 10) | 100 | 0 | 0 |
| Placebo (N = 30) | 100 | 0 | 0 |

The alternative construct, STF2R0.HA1-2 (VN) (SEQ ID NO: 453), was poorly efficacious with only 0 to about 10% of the mice surviving in each of the different groups. This underscores the importance of a functional TLR ligand in driving a strong, protective immune response when the animal or subject is immunologically naïve; or more specifically has no pre-existing immunity to the immunogen. None of the animals in the placebo (mock vaccinated) control group survived the challenge and the median survival was 6 days.

Figure 6A:
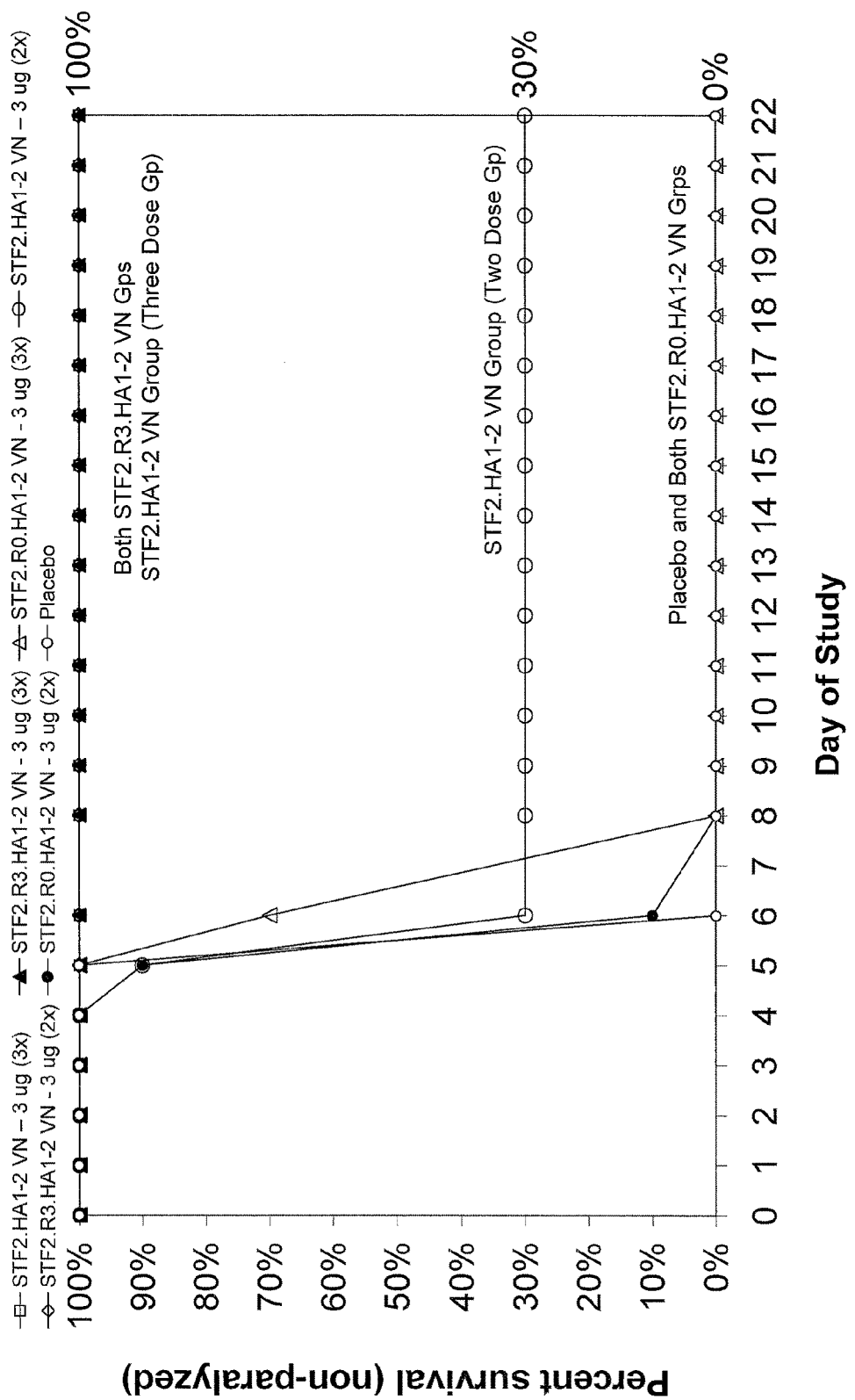
FIGS. 6A and 6B depict efficacy for the different globular head constructs following a three or two dose regimen of 3 µg. Six-week-old female BALB/c mice were vaccinated s.c. with 3 or 2 immunizations of the indicated construct prior to challenge. On day 0, the mice were infected i.n. with influenza A/Vietnam/1203/04 (VN04) with $6.8 \times 10^4$ $TCID_{50}$/mouse. Clinical observations of disease development and mortality were monitored at regular intervals from day 0 to day 21. The percentage of survivors is shown in (FIG. 6A), and the percentage change in body weight from baseline on day 0 is shown in (FIG. 6B). Legend Key: STF2.HA1-2 (VN) (SEQ ID NO: 451); STF2R0.HA1-2 (VN) (SEQ ID NO: 453); STF2R3.HA1-2 (VN) (SEQ ID NO: 452).
Figure 6B:
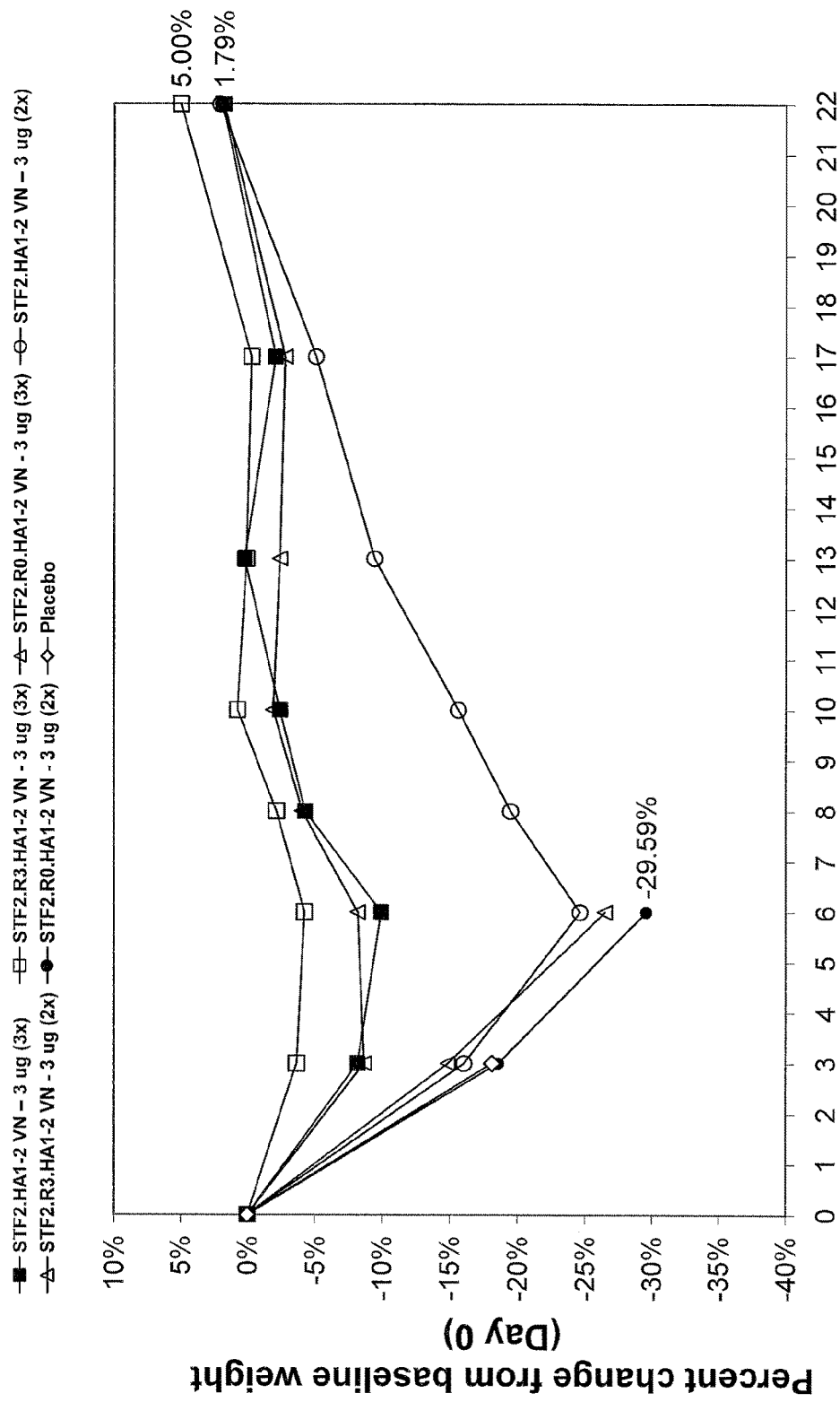

Similar to earlier results, 100% of animals receiving 3 doses of 3 μg of the STF2.HA1-2 (VN) (SEQ ID NO: 451) vaccine survived the challenge, while only about 30% of animals survived the challenge after 2 immunizations of 3 μg of the STF2.HA1-2 (VN) vaccine (SEQ ID NO: 451). In comparison, 100% of animals survived the challenge after receiving either 2 or 3 doses of 3 μg of the STF2R3.HA1-2 (VN) (SEQ ID NO: 452) vaccine. Thus, the STF2R3.HA1-2 (VN) vaccine (SEQ ID NO: 452) provides markedly improved efficacy against the highly pathogenic avian challenge. Survival and weight loss curves following the challenge are shown in FIGS. 6A and 6B for the 3 μg dose groups.

In summary, replacement of domain 3 of flagellin with the VN HA globular head substantially improved the immuno-potency and effectiveness of the vaccine against a lethal challenge in the mouse model.

Comparative Efficacy of STF2R3.HA1-2 (VN) (SEQ ID NO: 452) and STF2R3.2x.HA1-2 (VN) (SEQ ID NO: 455) in Ferrets:

In a head-to-head efficacy study, doses of 15 or 45 μg of STF2R3.HA1-2 (VN) (SEQ ID NO: 452) or STF2R3.2x.HA1-2 (VN) (SEQ ID NO: 455) were delivered twice at a 3 week interval to groups of six ferrets. On study day 56, or 7 weeks post the booster dose, ferrets were challenged with 10FLD50 (specifically, 10 times the dose of virus at which 50% of ferrets would succumb to the infection) of the Viet Nam 1203/2004 virus. Survival and virus titers in nasal washes were assessed (Table 8 and FIG. 7). As expected, 5 of 6 ferrets in the placebo group succumbed to the challenge whereas all animals in the vaccine groups survived the challenge.

TABLE 8

Summary of survival rates following a lethal challenge of ferrets

| Groups | Dose (μg) | N | Survivors |
|---|---|---|---|
| Placebo |  | 6 | 1 |
| STF2.R3.HA1-2 (VN) | 15 | 6 | 6 |
| STF2.R3.HA1-2 (VN) | 45 | 6 | 6 |
| STF2.R3.2xHA1-2 (VN) | 15 | 6 | 6 |
| STF2.R3.2xHA1-2 (VN) | 45 | 6 | 6 |

On days 3 and 5 post-infection nasal washes were obtained from the infected ferrets and were evaluated for virus titers, measured by infection of eggs and reported as 50% egg infectious dose (or $EID_{50}$)

Development of a Rabbit Model of Reactogenicity:

VaxInnate's VAX102 Phase I clinical trial utilized a full length flagellin construct fused at its C-terminus to 4 tandem copies of the ectodomain of the influenza ion channel protein, M2e (STF2.4xM2e) (SEQ ID NO: 457). While the vaccine was well tolerated at doses lesser than about 3 μg, at higher doses of the vaccine several subjects experienced headaches within 90 minutes after the priming immunization with the vaccine. Other symptoms included chills, nausea, vomiting and/or diarrhea. Some subjects had elevated temperatures. Several affected subjects also tested for elevated levels of C-reactive protein (CRP) on Day 1 following vaccination.

This constellation of symptoms is consistent with the elaboration of a vigorous pro-inflammatory response. In man, C-reactive protein (CRP) is known to rise dramatically during inflammatory processes within the body, most often in response to an increase in the pro-inflammatory cytokine IL-6. TLR signaling initiates the production of a pro-inflammatory cytokine cascade that begins with IL-1, TNF-α and IL-6 production. It is thought that this type of response is necessary to elicit robust adaptive immune responses and consistent with this, robust M2e specific IgG responses were observed for subjects tested in the VAX102 study. The adverse events observed in the clinical studies may be due to a transient pro-inflammatory cascade initiated by TLR5 signaling in response to the flagellin moiety of the VAX102 vaccine (SEQ ID NO: 457).

A rabbit model of reactogenicity was established. Fever, food consumption and CRP-levels measured 1 day following immunization (CRP ELISA kit, Immunology Consultants Laboratory, Newberg, Oreg.) were all found to be reliable measures a pro-inflammatory response. A goal was to establish a correlation between the clinical observations and this rabbit model of reactogenicity and to then use this model to predict the therapeutic window of a given vaccine in the clinical setting. More specifically, to predict the dose at which the vaccine was both immunogenic and non-reactogenic.

Figure 8A:
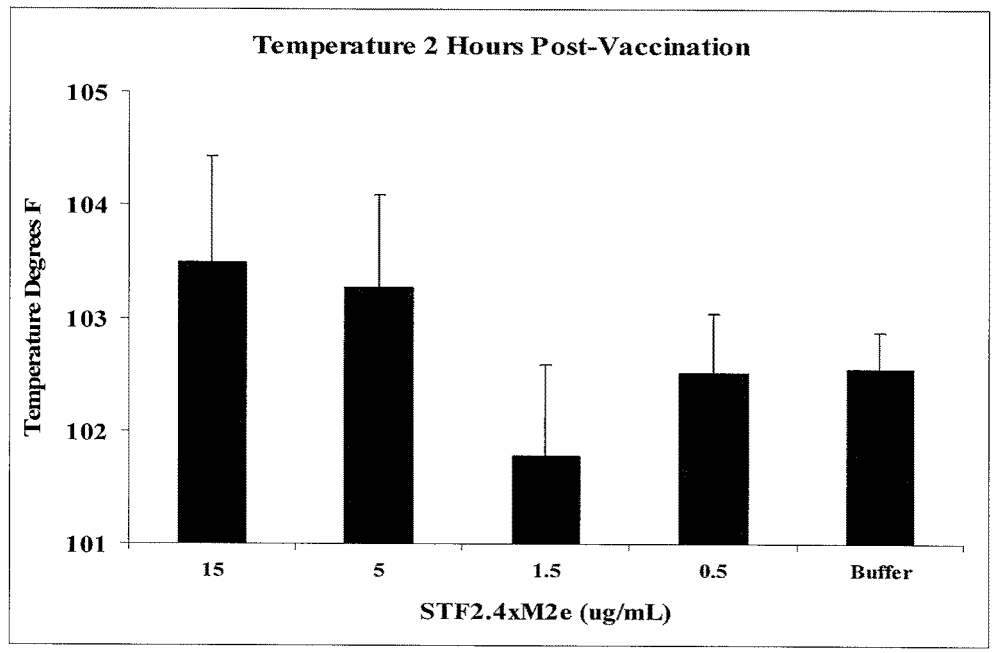
FIGS. 8A and 8B depict temperature and food consumption post-immunization with STF2.4xM2e.
Figure 8B:
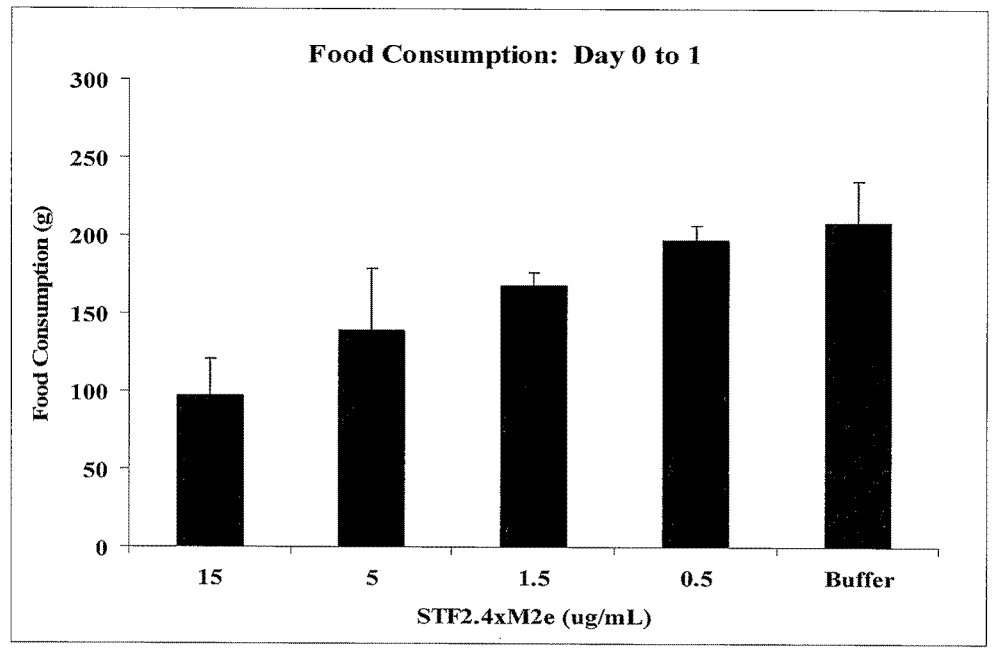

Non-clinical studies were performed using doses of STF2.4xM2e (SEQ ID NO: 457) surrounding the VAX102 clinical dose associated with adverse events. Temperature and food consumption were monitored and the results are shown (FIGS. 8, A and B). Animals receiving 15 or 5 μg of STF2.4xM2e (SEQ ID NO: 457) exhibited a low increase of about 0.5° F., which in this model is not considered significant. According to the USP rabbit pyrogenicity model increases in temperature of about 1.04° F. or greater are considered significant. Group mean temperatures for groups receiving doses of STF2.4xM2e (SEQ ID NO: 457) below 5 μg were indistinguishable from the control group. Food consumption was also measured in this study. Consumption for the 15 and 5 μg dose groups was reduced relative to baseline, animals in dose groups less that about 5 μg are essentially baseline. Thus, elevated temperature and reduced food consumption in the rabbit were observed at doses bracketing the clinical dose associated with adverse events, indicating that a correlation between rabbit and human exists for these measures.

Figure 9:
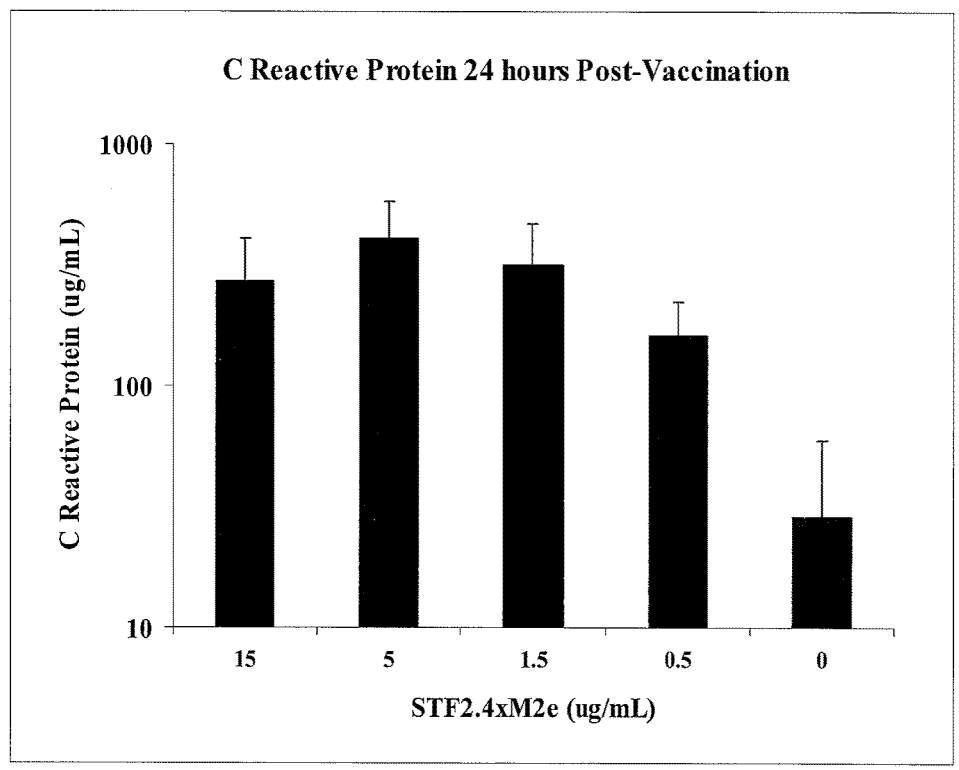
FIG. 9 depicts C reactive protein (CRP) levels post vaccination of rabbits. Groups of 6 rabbits were injected i.m. with the indicated dose of STF2.4xM2e (SEQ ID NO: 457) on day 0. Rabbits were bled about 24 hours after vaccination, serum was prepared and C reactive protein was measured (Immunology Consultants Laboratory, Newberg, Oreg.). Data is presented as group mean CRP±SD.

To further establish the rabbit as a relevant model for both clinical dose selection, the rabbit studies were next extended to evaluation of CRP levels. Rabbits were immunized with doses of STF2.4xM2e ranging from 15 to 0.5 μg. Sera were harvested at time 0 and at 24 hours post the prime immunization and CRP levels measured by ELISA. CRP was found to be elevated in rabbits 24 hours post-vaccination with STF2.4xM2e (FIG. 9). At the higher doses, CRP levels rose about 20 fold (average of 28 μg/ml to 600 μg/ml) while at the lower doses, levels rose about 10-fold. These elevations in the rabbit are at the clinically relevant doses of 5 and 15 μg. These results supported the development of CRP evaluation in the rabbit model as a potential predictive marker supporting dose selection.

The results demonstrate that the VAX102 vaccine is associated with elevated temperatures, a lack of food consumption and elevated CRP levels in the rabbit. All of these effects are related to dose. Fever, a lack of food consumption and elevated CRP levels are observed for doses within the original clinical dose range of about 10 to about 100 μg for VAX102. The effects return or trend to baseline at doses of 5 μg or less. Subsequently, low microgram doses of VAX102 (SEQ ID NO: 547) were found, as predicted by this rabbit model, to be immunogenic and non-reactogenic in the clinical setting.

Alternative Forms of Flagellin Provide Improved Reactogenicity Profiles

Comparison of the Reactogenicity Profiles for STF2.HA1-2 (VN) (SEQ ID NO: 451), STF2R3.HA1-2 (VN) (SEQ ID NO: 452) and STF2R3.2x.HA1-2 (VN) (SEQ ID NO: 455):

The reactogenicity profiles of STF2.HA1-2 (VN) (SEQ ID NO: 451), STF2R3.HA1-2 (VN) (SEQ ID NO: 452) and STF2R3.2x.HA1-2 (VN) (SEQ ID NO: 455) were compared in a head to head study. Groups of 6 rabbits were immunized with 1.5, 15 or 150 μg of STF2.HA1-2 VN (SEQ ID NO: 451), STF2R3.HA1-2 VN (SEQ ID NO: 452) or STF2R3.2x.HA1-2 VN (SEQ ID NO: 455). Temperature was measured on the occasion at 2 hours post-immunization while food consumption and CRP levels were measured at 24 hours post-immunization. The results are shown in FIG. 10A through 10H.

Consistent with the observations in the mouse model, the results show an improvement in immunogenicity of the R3 and R3.2x constructs as compared to STF2.HA1-2 (VN) (SEQ ID NO: 451). Unexpectedly, the results also an improvement in the reactogenicity profile for the STF2R3.HA1-2 (VN) (SEQ ID NO: 452) construct at all doses as compared to the standard STF2.HA1-2 construct (SEQ ID NO: 451). Even greater improvements in the reactogenicity profile were observed for the STF2R3.2x.HA1-2 (VN) construct (SEQ ID NO: 455), particularly for the temperature and CRP measures.

Conclusion

These data show that immunogenicity and efficacy can be substantially enhanced while reactogenicity is reduced in a profile of the pandemic vaccine by replacing domain 3 of flagellin with the HA globular head. The addition of a second globular head to the construct further improved the reactogenicity profile of the vaccine.

Example 2

H1 HA Globular Head Vaccines Utilizing R3 Forms of Flagellin Provide Improved Reactogenicity Profiles while Maintaining Immunopotency Materials and Methods
Vaccine Production
Cloning of Recombinant STF2.HA1-2 PR8 and STF2R3.HA1-2 PR8 Genes:

For construction of the STF2.HA1-2 PR8 gene (SEQ ID NO: 458) the hemagglutinin (HA) globular head domain of PR8 was genetically fused to the C-terminus of the full-length sequence of *Salmonella typhimurium* fljB (flagellin phase 2), STF2 encoded by a 1.5 kb gene (SEQ ID NO: 488). A sub-fragment of the HA gene encoding PR8 HA1-2 (aa 62-284 of SEQ ID NO: 459), was first made as a codon-optimized synthetic gene in fusion with STF2 (DNA2.0 Inc., Menlo Park, Calif.). The heptameric sequence Ser-Gly-Ser-Gly-Ser-Gly-Ser (SGSGSGS) (SEQ ID NO: 498 was incorporated at the junction of STF2 and HA as a flexible linker. The 2.2 kb fragments corresponding to the flagellin-HA1-2 synthetic gene was excised from the appropriate plasmid with NdeI and BlpI, gel purified and ligated by compatible ends to pET24a to generate the STF2.HA1-2 PR8 construct (SEQ ID NO: 458).

For construction of the STF2R3.HA1-2 PR8 gene (SEQ ID NO: 489), a two-step PCR reaction was used to replace the D3 domain of STF2 with HA1-2 (PR8) (SEQ ID NO: 458). In the first step, DNA from pET24a-STF2.HA1-2 PR8 (SEQ ID NO:458) was used as a DNA template and primers were used to amplify the N terminus and C terminus of STF2, respectively. Primers were used to amplify the PR8 HA1-2 globular head. In the second PCR step, gel purified STF2 and HA1-2 (PR8) fragments were used as DNA templates. Primers in an overlapping PCR reaction. The final PCR product was digested with the restriction enzymes NdeI and EcoRI, gel purified and ligated by compatible ends to pET24a to generate the STF2R3.HA1-2 PR8 construct (SEQ ID NO: 489).

Constructs were verified by DNA sequencing and used to transform the expression host strain, BLR3 (DE3) (Novagen, San Diego, Calif.; Cat #69053). Transformants were selected on plates containing kanamycin (50 μg/ml), tetracycline (5 μg/ml) and glucose (0.5%).

Cloning of Recombinant STF2.HA1-2 SI and STF2R3.HA1-2 SI Genes:

For construction of the STF2.HA1-2 SI gene (SEQ ID NO: 461) the hemagglutinin (HA) globular head domain of A/Solomon Islands/3/2006 (SI) was genetically fused to the C-terminus of the full-length sequence of *Salmonella typhimurium* fljB (flagellin phase 2), STF2 encoded by a 1.5 kb gene (SEQ ID NO: 488). A sub-fragment of the HA gene encoding SI HA1-2 (aa 62-284) (SEQ ID NO: 462), was first made as a codon-optimized synthetic gene in fusion with STF2 (DNA2.0 Inc., Menlo Park, Calif.). The 2.2 kb fragments corresponding to the flagellin-HA1-2 synthetic gene was excised from the appropriate plasmid with NdeI and BlpI, gel purified and ligated by compatible ends to pET24a to generate the STF2.HA1-2 SI construct (SEQ ID NO: 461).

For construction of the STF2R3.HA1-2 SI gene (SEQ ID NO: 490) a two-step PCR was used to replace D3 domain of STF2 with HA1-2 (SI). In the first step, DNA from pET24a-STF2.HA1-2 SI (SEQ ID NO:461) was used as a DNA template, primers were used to amplify STF2 N-terminal and C-terminal respectively. Primers to amplify the SI HA1-2 globular head. In the second PCR step, gel purified STF2 and HA1-2 (SI) fragments were used as DNA templates. Primers in an overlapping PCR reaction. The final PCR product was digested with the restriction enzymes NdeI and EcoRI, gel purified and ligated by compatible ends to pET24a to generate the STF2R3.HA1-2 SI construct (SEQ ID NO: 490).

Constructs were verified by DNA sequencing and used to transform the expression host strain, BLR3 (DE3) (Novagen, San Diego, Calif.; Cat #69053). Transformants were selected on plates containing kanamycin (50 μg/ml), tetracycline (5 μg/ml) and glucose (0.5%).

Protein Purification:

STF2.HA1-2 PR8, STF2R3.HA1-2 PR8, STF2.HA1-2 SI, and STF2R3.HA1-2 SI clones were cultured overnight and the culture used to inoculate fresh LB medium supplemented with 25 μg/ml kanamycin, 12.5 μg/ml tetracycline and 0.5% glucose. At an $OD_{600}$=0.6 protein expression was induced with 1 mM IPTG for about 3 h at about 37° C. Cells were harvested by centrifugation (8000×g for 7 minutes) and resuspended in 2× phosphate buffered saline (2×PBS: 24 mM $KH_2PO_4/Na_2HPO_4$, 274 mM NaCl, 5.4 mM KCl), 1% glycerol, DNAse, 1 mM PMSF, protease inhibitor cocktail and 1 mg/ml lysozyme. The pellet was dissolved in 8M urea, 25 mM NaCl and 50 mM Acetate, pH 4.0 and applied to a 30 ml SP Sepharose Fast Flow column (XK16, GE/Amersham) pre-equilibrated with 50 mM Acetate, 25 mM NaCl and 8M urea, pH 4.0. The peak fraction was concentrated and buffer exchanged to 50 mM Tris, 25 mM NaCl and 8M urea, pH8.0. Protein refolding was achieved by rapid dilution (1:10) into 100 mM Tris-HCl buffer (pH 8.0), and loaded onto a 45 ml Source Q column (XK16, GE/Amersham). Bound protein was eluted with a linear salt gradient from 0 to 1.0 M NaCl in 100 mM Tris-HCl, pH 8.0.

For final preparations and endotoxin removal, peak fractions were pooled and loaded directly onto a Superdex 200 gel filtration column (10/300 GL, GE/Amersham) pre-equilibrated in 100 mM Tris, 150 mM NaCl, 1% glycerol and 1% Na-deoxycholate. Residual endotoxin was assayed by using standard Chromogenic Limulus Amebocyte Lysate assay (Cambrex, Walkersville, Md.) as directed by the manufacturer. Peak fractions from the included volume of the column were pooled, dialyzed against 1× PBS and stored at −80° C.

Protein Characterization:

Proteins were characterized for purity, identity, endotoxin content, and biological activity using the following assays.

SDS-PAGE:

Proteins (typically about 5 μg) were diluted in SDS-PAGE sample buffer (1% SDS, 30 mM Tris-HCl, pH 6.8, 4% glycerol, 0.1 mg/ml bromophenol blue) with and without 5 mM β-mercaptoethanol. The samples were boiled for 5 minutes and loaded onto a 4-20% SDS polyacrylamide gel. Following electrophoresis, gels were stained with coomassie blue to visualize protein bands.

Endotoxin assay:

Residual endotoxin was assayed by using standard Chromogenic Limulus Amebocyte Lysate assay (Cambrex, Walkersville, Md.) as directed by the manufacturer.

Protein Assay:

Protein concentrations were determined by the MicroBCA Protein Assay Reagent Kit in a 96-well format using BSA as a standard (Pierce Biotechnology), following the manufacturer's instructions.

Flagellin ELISA:

Protein integrity and concentration were examined by ELISA with antibodies specific for flagellin. ELISA plates (96 wells) were coated overnight at 4° C. with serial dilutions of each target protein, in PBS starting at 5 μg/ml. Plates were blocked with 200 μl/well of Assay Diluent Buffer (ADB; BD Pharmingen) for one hour at room temperature then washed three times in phosphate-buffered saline containing Tween-20 (PBS-T, 12 mM $NaPO_4$, 137 mM NaCl, 2.7 mM KCl, 0.05% Tween 20). Rabbit polyclonal anti-flagellin antibody diluted in ADB (100 μl/well, 1:5000) was added to all wells and the plates were incubated for 1 hour at room temperature or overnight at 4° C., then washed three times with PBS-T. HRP-labeled goat anti-rabbit IgG antibody (Jackson Immunochemical) diluted in ADB was added (100 μl/well, 1:5000) and the plates were incubated at room temperature for 1 hour. The plates were washed three times with PBS-T. After adding TMB Ultra substrate (Pierce) and monitoring color development, $A_{450}$ was measured on a Tecan Farcyte microplate spectrophotometer.

TLR5 Bioactivity Assay:

HEK293 cells (ATCC, Cat #CRL-1573, Manassas, Va.) constitutively express TLR5, and secrete several soluble factors, including IL-8, in response to TLR5 signaling. Cells were seeded in 96 well microplates (50,000 cells/well), and recombinant test proteins were added. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce; Rockford, Ill., #M801E and #M802B) following the manufacturer's instructions. Optical density was measured using a microplate spectrophotometer.

Vaccine Assessment

Animal Studies:

BALB/c mice (Charles River, Charles River, Mass.) 6-8 weeks old were purchased from the Jackson Laboratory (Bar Harbor, Me.) and housed in either the Yale University vivarium (New Haven, Conn.) or the Princeton University vivarium (Princeton, N.J.). All studies were performed in accordance with the University Institutional Animal Care and Use Committees (IACUC). Recombinant proteins were prepared in one of two vehicles: PBS (phosphate-buffered saline) or formula F147 (10 mM L-histidine, 150 mM NaCl, 5% trehalose, 0.02% polysorbate 80, 0.1 mM EDTA, 0.5% ethanol, 10 mM Tris, pH 7.2). Vehicles were used interchangeably without detectable impact on the results. Mice were immunized subcutaneously (s.c.) on days 0 and 14. On days 13 (primary) and 21 (boost), individual mice were bled by retro-orbital puncture. Sera were harvested by clotting and centrifugation of the heparin-free blood samples.

Studies with female and male New Zealand White rabbits were performed at Covance Research Products (Denver, Pa.). Rabbits (6/group) were immunized intramuscularly (i.m.) on days 0 and 21 with 5 or 15 μg of STF2.HA1-2. Sera were harvested 3 weeks post the booster and evaluated for HA-specific microneutralization titers.

Figure 12:
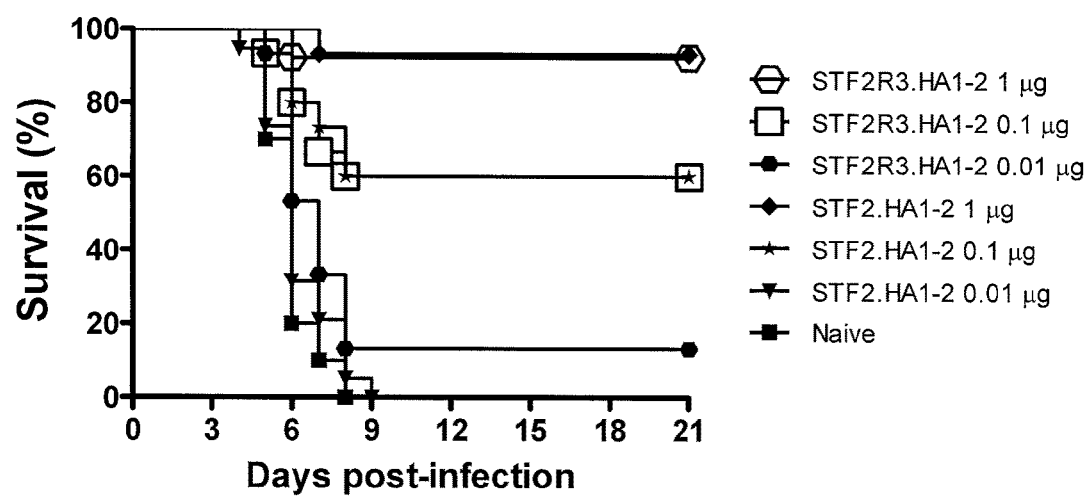
FIG. 12 depicts protection against viral challenge by STF2.HA1-2 PR8 (SEQ ID NO: 460) and STF2R3.HA1-2 PR8 (SEQ ID NO: 464). Balb/c mice (10 per group) were immunized with the indicated doses of either STF2.HA1-2 or STF2R3.HA1-2 PR8 on days 0 and 14. On day 42 mice were challenged with 1000 TCID$_{50}$ of influenza H1N1 PR/34/8 i.n. Mice were monitored for weight loss and survival daily. By protocol, mice were euthanized if they lost about ≥20% weight.
Figure 13A:
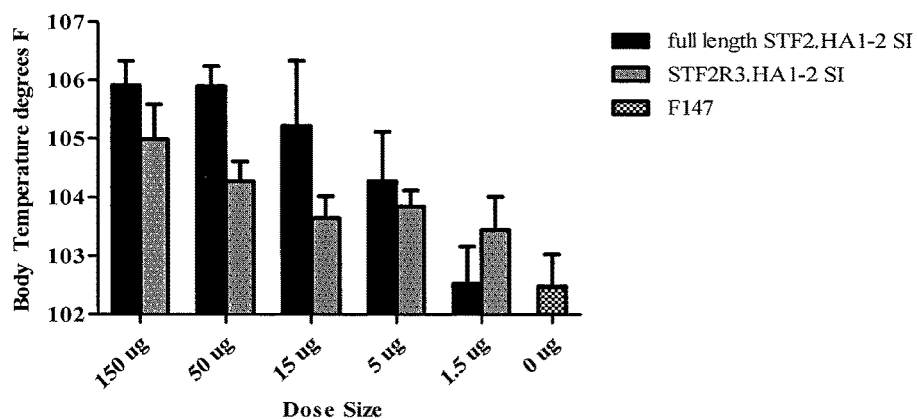
FIGS. 13A and 13B depict a comparison of STF2.HA1-2 SI (SEQ ID NO: 463) and STF2R3.HA1-2 SI (SEQ ID NO: 465) reactogenicity profiles. Rabbits (6 per group) were immunized i.m. with the indicated doses of STF2-linked vaccine. Body temperature was recorded rectally 6 hours post-immunization (FIG. 13A). Food consumption was recorded from the day of immunization to one day post-immunization (FIG. 13B). Data are graphed as group mean with standard deviations indicated by error bars.
Figure 13B:
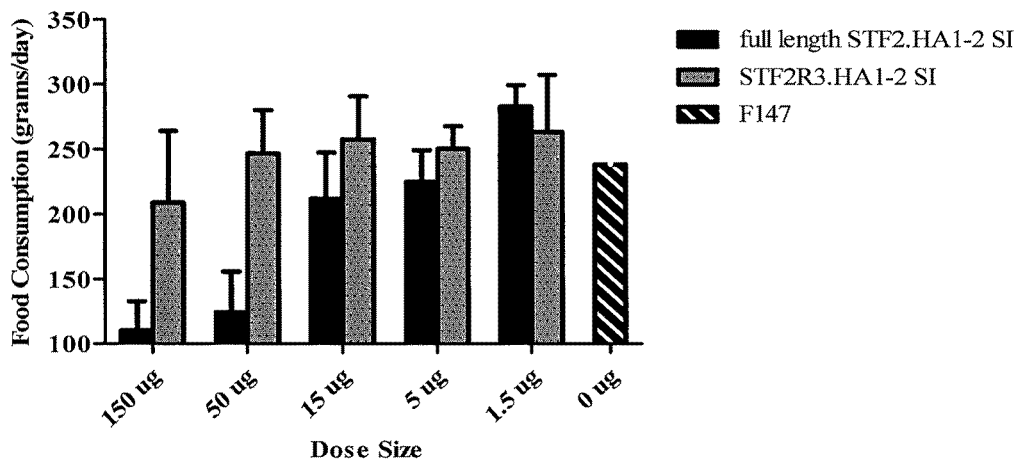

Reactogenicity Evaluations:

Rabbits (6/group) were immunized intramuscularly (i.m.) on days 0 and 21. Sera were harvested 1 day post the priming immunization for CRP measurements (CRP ELISA kit, Immunology Consultants Laboratory, Newberg, Oreg.). Food consumption was measured from day 0 to day 1. Body Temperature was measured rectally between 2 and 10 hours post-immunization.

Influenza Virus Challenge of Mice:

To assess efficacy, mice immunized on days 0 and 14 were challenged on day 35 by intranasal administration of $1\times LD_{90}$ (dose lethal to 90% of mice; about $1\times10^3$ TCID50) (TCID=Tissue Culture Infectious Doses) of influenza A isolate, PR8. Animals were monitored daily for 21 days following the challenge for survival and weight loss.

Results and Discussion

Comparative Reactogenicity Profiles for the H1N1 Constructs STF2.HA1-2 PR8 (SEQ ID NO: 460) and STF2R3.HA1-2 PR8 (SEQ ID NO: 464):

The C-terminal fusion molecule STF2.HA1-2 PR-8 (SEQ ID NO:460) was compared to STF2R3.HA1-2 PR8 (SEQ ID NO: 464) in the rabbit model, to determine reactogenicity, and a mouse model to test efficacy. In the reactogenicity model, six rabbits per group were immunized i.m. with 50, 15, 5, 1.5 and 0.5 μg of either STF2.HA1-2 PR-8 (SEQ ID NO: 460) or STF2R3.HA1-2 PR8 (SEQ ID NO: 464). Body temperature was measured rectally on the day before immunization, 10 hours and days 1 through 3 after the priming immunization. Food consumption was measured for 1 day following immunization. Rabbits were bled the day before and 1 day after immunization for determination of serum CRP levels using a commercial kit (Immunology Consulting Laboratories, Newberg Oreg.).

As shown in FIGS. 11A-11C, while both constructs demonstrate dose-dependent effects on food consumption, temperature and CRP levels, the comparative results indicate that the STF2.HA1-2 PR8 (SEQ ID NO: 460) construct which involves fusion of the antigen to the C terminus of full length flagellin, causes a stronger reactogenic response than STF2R3.HA1-2 PR8 (SEQ ID NO: 464). Immunization with the C-terminal fusion drives a higher increase in body temperature and CRP and causes a greater loss of appetite than the equivalent dose of STF2R3.HA1-2 PR8 (SEQ ID NO: 464).

To assess comparative efficacy of the STF2.HA1-2 PR8 (SEQ ID NO: 460) and STF2R3.HA1-2 (SEQ ID NO: 464) constructs groups of 10 Balb/c mice were immunized with 1, 0.1 or 0.01 μg of the protein at a two week interval. Three weeks post the second dose animals were challenge with 1×LD90 of the PR8 virus. Survival rates were followed for 21 days post-challenge. Consistent with the immununogenicity results in the rabbit, the results of the virus challenge in mice show that for the full length and R3 forms of flagellin are equally immunogenic and protective (FIG. 12).

In summary, the results from the rabbit and mouse studies show that the same principles of design used for the H5 constructs can be used to generate an R3 construct with the H1 PR8 globular head as the vaccine antigen and that the resulting construct (SEQ ID NO: 464) has a reduced reactogenicity profile without compromising the immunopotency of the construct.

Comparative Reactogenicity Profiles for H1N1 Constructs STF2.HA1-2 SI (SEQ ID NO: 463) and STF2R3.HA1-2 SI (SEQ ID NO: 465):

STF2.HA1-2 (SI) (SEQ ID NO: 463) comprises the globular head domain (HA1-2) of A/Solomon Islands/3/2006 HA fused to the C terminus of *Salmonella typhimurium* (type 2) flagellin (STF2) (SEQ ID NO: 447). The C-terminal fusion construct STF2.HA1-2 SI (SEQ ID NO: 463) was compared to STF2R3.HA1-2 SI (SEQ ID NO: 465) in the rabbit model to evaluate relative reactogenicity. In the reactogenicity model, six rabbits per group were immunized i.m. with 50, 15, 5, 1.5 µg of either STF2.HA1-2 SI (SEQ ID NO: 463) or STF2R3.HA1-2 SI (SEQ ID NO: 465). A group receiving formulation buffer, F147, alone was included as a control. Rabbits were monitored for responses to the vaccine: body temperature was taken 1 day prior to immunization, 6 hours post-immunization and 1, 2 and 3 days post-immunization. Food consumption was monitored at 1 day intervals from 1 day before to three days post-immunization. As shown in FIG. 12, body temperature 6 hours post-immunization was increased and food consumption decreased within the first day of vaccination in a dose-dependent fashion by STF2.HA1-2 SI (SEQ ID NO: 463) with the highest dose, 150 µg, having the largest effect. Administration of STF2R3.HA1-2 SI (SEQ ID NO: 465), however, had a smaller effect at the same doses; at 150 µg, the rabbits experienced a more modest elevation of temperature and much less of an effect on food consumption compared to STF2.HA1-2 SI (SEQ ID NO: 463). At the 50 µg dose, i.m. injection of STF2R3.HA1-2 SI (SEQ ID NO: 465) did not affect food consumption relative to the buffer control (F147).

Conclusion

These data show that deletion of the D3 domain of flagellin and replacement with a vaccine antigen can consistently lead to a reduction in the reactogenicity profile of the flagellin fusion vaccine.

Example 3

Influenza B HA Globular Head Vaccines Utilizing R3 and R32X Forms of Flagellin Provide an Improved Reactogenicity Profile Materials and Methods Cloning of Recombinant STF2R3.HA1-2 B FLA and STF2R32x.HA1-2 B FLA Genes:

For construction of the STF2R3.HA1-2 B FLA gene (SEQ ID NO: 466) the hemagglutinin (HA) globular head domain of Influenza B/Florida/04/2006 was used to replace the domain D3 of *Salmonella typhimurium* fljB (flagellin phase 2) (SEQ ID NO: 488). A sub-fragment of the HA gene encoding B FLA HA1-2 (aa 52-291) (SEQ ID NO: 467) was first made as a codon-optimized synthetic gene (DNA2.0 Inc., Menlo Park, Calif.) and was incorporated into STF2 by two-step PCR. In the first step, DNA from pET24a-STF2.HA1-2 FLA (SEQ ID NO: 483) was used as DNA template, and primers employed to amplify STF2 N-terminal and C-terminal respectively, and primers were used to amplify HA1-2 (FLA). In the second step, the STF2 and HA1-2 (FLA) fragments from the first PCR step were gel purified and were used as DNA templates along with primers for the $2^{nd}$-step overlapping PCR reaction. The final PCR product was digested with NdeI and EcoRI, gel purified and ligated by compatible ends to pET24a to generate the STF2R3.HA1-2 (FLA) construct (SEQ ID NO: 466). To generate the STF2R3.2xHA1-2 (FLA) gene, (SEQ ID NO: 469), DNA from pET24a-STF2.HA1-2 FLA (SEQ ID NO: 483) was digested with NdeI and MfeI. The gel-purified 6.6 kb fragment served as the vector. DNA from pET24a-STF2R3.HA1-2 FLA (SEQ ID NO: 466) was digested with NdeI and MfeI. Gel-purified 1.4 kb fragment serves as insert. Vector and insert DNA were ligated to generate the STF2R3.2xHA1-2 FLA construct. All constructs were verified by DNA sequencing and used to transform the expression host strain, BLR3 (DE3) (Novagen, San Diego, Calif.; Cat #69053). Transformants were selected on plates containing kanamycin (50 µg/ml), tetracycline (5 µg/ml) and glucose (0.5%).

Protein Purification:

STF2R3.HA1-2 B FLA (SEQ ID NO: 470) and STF2R3.2x.HA1-2 B FLA (SEQ ID NO: 471) clones were cultured overnight and the culture used to inoculate fresh LB medium supplemented with 25 µg/ml kanamycin, 12.5 µg/ml tetracycline and 0.5% glucose. At an $OD_{600}$=0.6 protein expression was induced with 1 mM IPTG for 3 h at 37° C. Cells were harvested by centrifugation (8000×g for 7 minutes) and resuspended in 2× phosphate buffered saline (2×PBS: 24 mM $KH_2PO_4$/$Na_2HPO_4$, 274 mM NaCl, 5.4 mM KCl), 1% glycerol, DNAse, 1 mM PMSF, protease inhibitor cocktail and 1 mg/ml lysozyme. The pellet was dissolved in 8M urea, 25 mM NaCl and 50 mM Acetate, pH 4.0 and applied to a 30 ml SP Sepharose Fast Flow column (XK16, GE/Amersham) pre-equilibrated with 50 mM Acetate, 25 mM NaCl and 8M urea, pH 4.0. The peak fraction was concentrated and buffer exchanged to 50 mM Tris, 25 mM NaCl and 8M urea, pH8.0. Protein refolding was achieved by rapid dilution (1:10) into 100 mM Tris-HCl buffer (pH 8.0), and loaded onto a 45 ml Source Q column (XK16, GE/Amersham).

Bound protein was eluted with a linear salt gradient from 0 to 1.0 M NaCl in 100 mM Tris-HCl, pH 8.0. For final preparations and endotoxin removal, peak fractions were pooled and loaded directly onto a Superdex 200 gel filtration column (10/300 GL, GE/Amersham) pre-equilibrated in 100 mM Tris, 150 mM NaCl, 1% glycerol and 1% Na-deoxycholate. Peak fractions from the included volume of the column were pooled, dialyzed against 1×PBS and stored at −80° C.

Protein Characterization:

Proteins were characterized for purity, identity, endotoxin content, and biological activity using the following assays.

SDS-PAGE:

Proteins (typically 5 µg) were diluted in SDS-PAGE sample buffer (1% SDS, 30 mM Tris-HCl, pH 6.8, 4% glycerol, 0.1 mg/ml bromophenol blue) with and without 5 mM β-mercaptoethanol. The samples were boiled for about 5 minutes and loaded onto a 4-20% SDS polyacrylamide gel. Following electrophoresis, gels were stained with coomassie blue to visualize protein bands.

Endotoxin Assay:

Residual endotoxin was assayed by using standard Chromogenic Limulus Amebocyte Lysate assay (Cambrex, Walkersville, Md.) as directed by the manufacturer.

Protein Assay:

Protein concentrations were determined by the MicroBCA Protein Assay Reagent Kit in a 96-well format using BSA as a standard (Pierce Biotechnology), following the manufacturer's instructions.

Flagellin ELISA:

Protein integrity and concentration were examined by ELISA with antibodies specific for flagellin. ELISA plates (96-well) were coated overnight at 4° C. with serial dilutions of each target protein, in PBS starting at about 5 µg/ml. Plates were blocked with 200 µl/well of Assay Diluent Buffer (ADB; BD Pharmingen) for one hour at room temperature then washed three times in phosphate-buffered saline containing Tween-20 (PBS-T, 12 mM $NaPO_4$, 137 mM NaCl, 2.7 mM KCl, 0.05% Tween 20). Rabbit polyclonal anti-flagellin antibody diluted in ADB (100 µl/well, 1:5000) was added to all wells and the plates were incubated for 1 hour at room temperature or overnight at 4° C., then washed three times with PBS-T. HRP-labeled goat anti-rabbit IgG antibody (Jackson Immunochemical) diluted in ADB was added (100 µl/well, 1:5000) and the plates were incubated at room temperature for 1 hour. The plates were washed three times with PBS-T. After adding TMB Ultra substrate (Pierce) and monitoring color development, $A_{450}$ was measured on a Tecan Farcyte microplate spectrophotometer.

TLR5 Bioactivity Assay:

HEK293 cells (ATCC, Cat #CRL-1573, Manassas, Va.) constitutively express TLR5, and secrete several soluble factors, including IL-8, in response to TLR5 signaling. Cells were seeded in 96 well microplates (50,000 cells/well), and recombinant test proteins were added. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce; Rockford, Ill., #M801E and #M802B) following the manufacturer's instructions. Optical density was measured using a microplate spectrophotometer.

Rabbit Reactogenicity and Immunogenicity Studies:

Animals:

Studies with female and male New Zealand White rabbits were performed at Covance Research Products (Denver, Pa.).

Reactogenicity Evaluations:

Rabbits (6/group) were immunized intramuscularly (i.m.) on days 0 and 21. Sera were harvested 1 day post the priming immunization for CRP measurements (CRP ELISA kit, Immunology Consultants Laboratory, Newberg, Oreg.). Food consumption was measured from day 0 to day 1.

Virus ELISA:

Egg-grown influenza B Florida/4/2006 was inactivated using beta propiolactone (BPL, Sigma-Aldrich, St. Louis, Mo.). In brief, virus was mixed with BPL at 0.05% for 4 hours at room temperature, followed by 24 hours at 4° C. The optimal coating dilution was determined using sheep anti-B Florida reference serum from NIBSC (Hertfordshire, UK). Costar Hi-bind EIA plates (Fisher Scientific, Pittsburgh, Pa.) were coated with inactivated B Florida in 1×PBS (EMD, Gibbstown, N.J.) at 1:10 overnight at 4 C. A standard curve of rabbit IgG (AbD Serotec, Raleigh, N.C.) was also coated overnight. Plates are washed the next day and blocked with 300 µl of Superblock with T20 (Thermo, Hudson, N.H.) for 2 hours at 25 C. Dilutions of sera were prepared beginning at a 1:25 fold dilution and continuing by 5-fold steps in duplicate using Superblock. Blocked plates are washed 3× with 1×PBS/ 0.05% Tween (Mallinckrodt Baker, Phillipsburg, N.J.) and the diluted sera and controls are added to the virus coated wells. Superblock alone is added to wells coated with rabbit IgG. Following 2 hour incubation at 25° C., plates were washed again and incubated with 100 µl of a 1:10,000 dilution of HRP-conjugated anti-rabbit IgG antibodies (Jackson ImmunoResearch, West Grove, Pa.) for 40 to 45 minutes. Plates are washed 3 times and 100 µl of pre-warmed TMB substrate (Thermo, Hudson, N.H.) was added to the wells. Color development was allowed for 3.5 minutes after which 100 µl of 1 M H2SO4 (Mallinckrodt Baker, Phillipsburg, N.J.) was added to stop the reaction. OD 450 nM was read within 40 minutes of stopping the reaction (Spectramax 190, Molecular Devices, Sunnyvale, Calif.). The concentration of anti-B Florida IgG antibodies were determined using a 4-parameter logistic curve generated from the rabbit IgG standards and their resulting O.Ds.

Results and Discussion

Comparative Reactogenicity and Immunogenicity Profiles for the Influenza B Constructs STF2.HA1-2 B FLA (SEQ ID NO: 468) and STF2R3.HA1-2 B FLA (SEQ ID NO: 470):

The STF2R3.HA1-2 B FLA (SEQ ID NO: 470) and the STF2R3.2x.HA1-2 B FLA (SEQ ID NO: 471) constructs were evaluated in the rabbit model, to determine reactogenicity. Six rabbits per group were immunized i.m. with 150 or 15 µg of either STF2R3.HA1-2 B FLA (SEQ ID NO: 470) or STF2R32x.HA1-2 B FLA (SEQ ID NO: 471). A group receiving the formulation buffer, F147, alone was included as a negative control. Food consumption was measured for 1 day following immunization. Rabbits were bled the day before and 1 day after immunization for determination of serum CRP levels using a commercial kit (Immunology Consulting Laboratories, Newberg Oreg.). The results are shown in FIGS. 14 A and B.

Figure 11A:
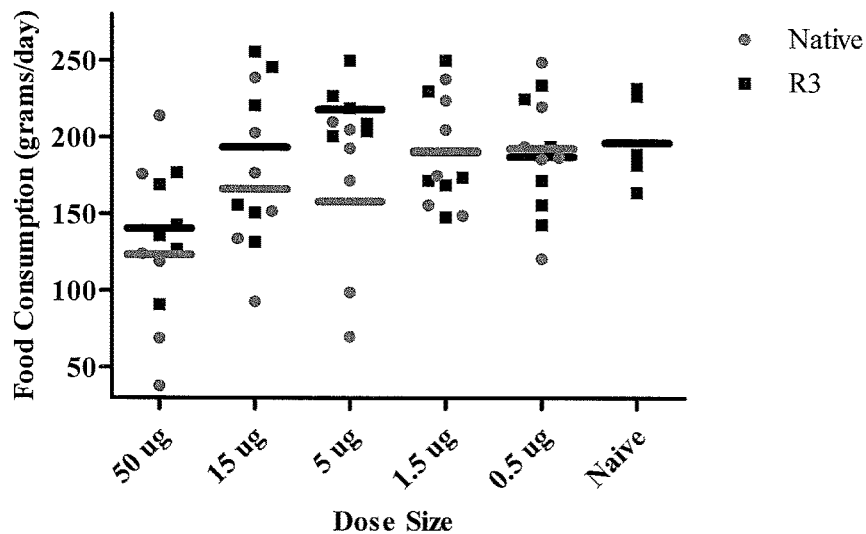
FIGS. 11A-11C depict a comparison of STF2.HA1-2 PR8 (referred to as Native in the legend) (SEQ ID NO: 460) and STF2R3.HA1-2 PR8 (referred to as R3 in the legend) (SEQ ID NO: 464) reactogenicity profiles. Groups of 6 rabbits were immunized i.m. with the indicated doses of vaccine. Food consumption was measured from the day of immunization until 1 day after (FIG. 11A). Body temperature was determined rectally at 10 hours post-immunization (FIG. 11B). Serum was measured for C reactive protein (CRP) at 24 hours post-immunization (FIG. 11C). Data points represent results of individual animals while bars represent means.
Figure 11B:
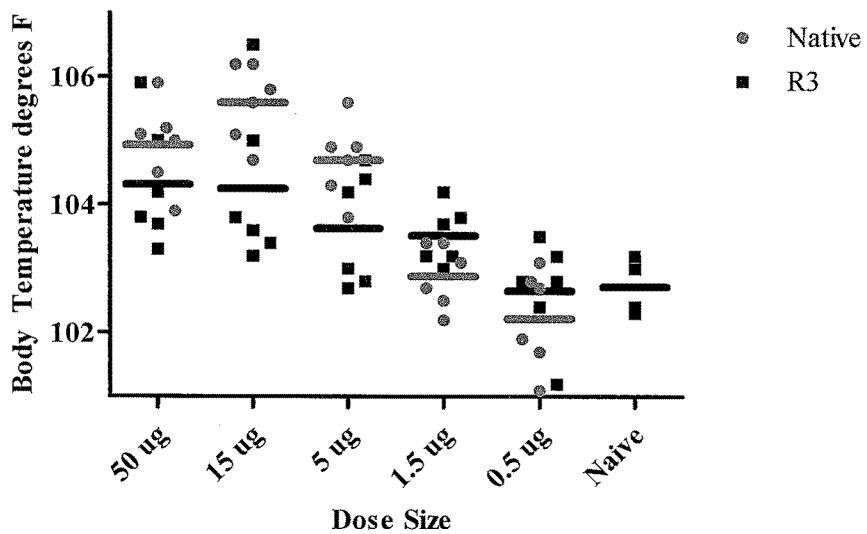
Figure 11C:
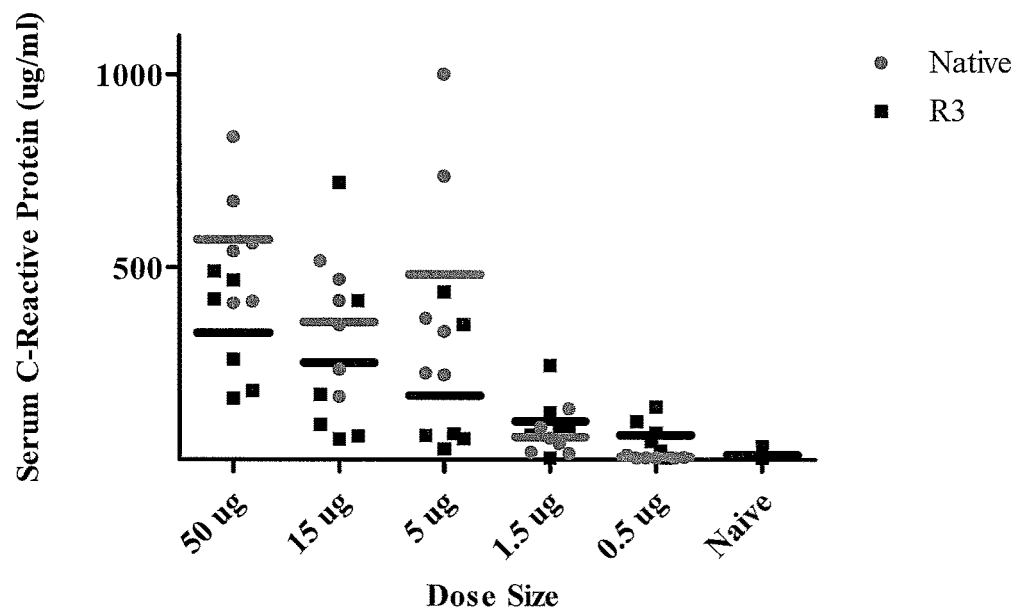
Figure 14A:
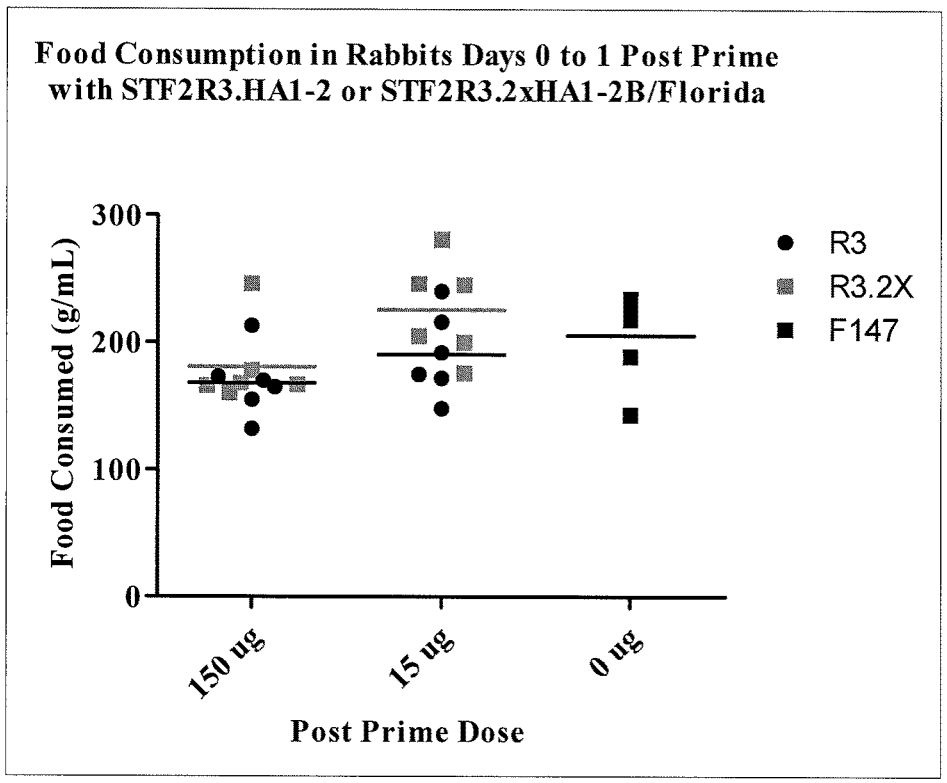
FIGS. 14A and 14B depict an evaluation of STF2R3.HA1-2 B FLA (R3) (SEQ ID NO: 470) and STF2R3.HA1-2 B FLA (R3.2x) (SEQ ID NO: 471) reactogenicity profiles. Groups of 6 rabbits were immunized i.m. with the indicated doses of vaccine. Food consumption was measured from the day of immunization until 1 day after (FIG. 14A). Serum was measured for C reactive protein (CRP) at 24 hours post-immunization (FIG. 14B). Data points represent results of individual animals while bars represent means.
Figure 14B:
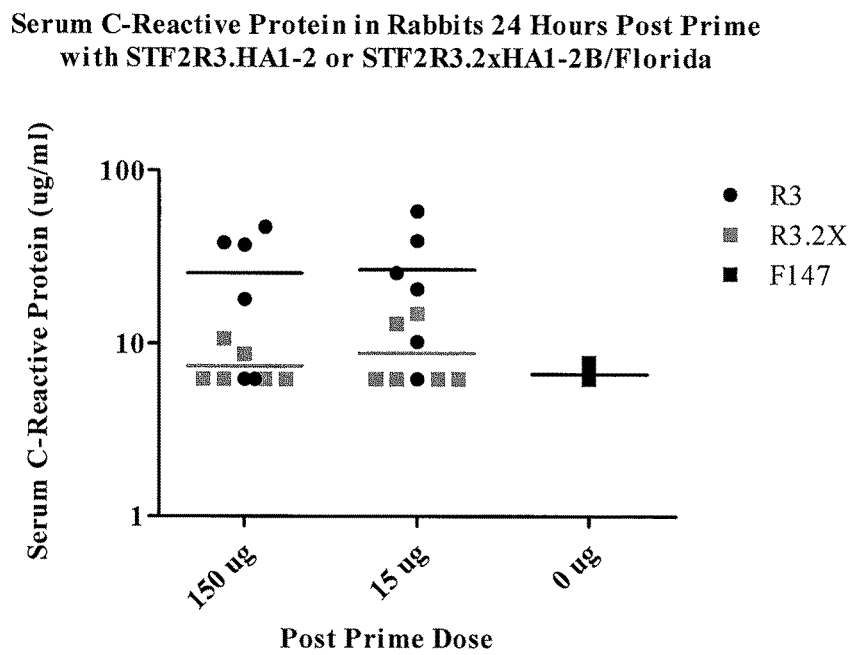

As shown in FIGS. 14 A and B, at the 15 µg dose, neither construct led to a significant reduction in food consumption as compared to the control group receiving formulation buffer (F147) alone. At the 150 µg dose, only a modest reduction was observed for the R3 (SEQ ID NO: 470) construct while no reduction in food consumption was observed for the R3.2x group (SEQ ID NO: 471). Very modest elevations in CRP levels were observed for the R3 (SEQ ID NO: 470) construct at either dose (range 10-80 µg/ml as compared to the typical 400 to 600 µg/ml observed for full length flagellin constructs shown in FIGS. 9, 10 and 11) whereas only sporadic, minimal elevations in CRP levels were observed for the R3.2x construct (SEQ ID NO: 471).

Figure 15:
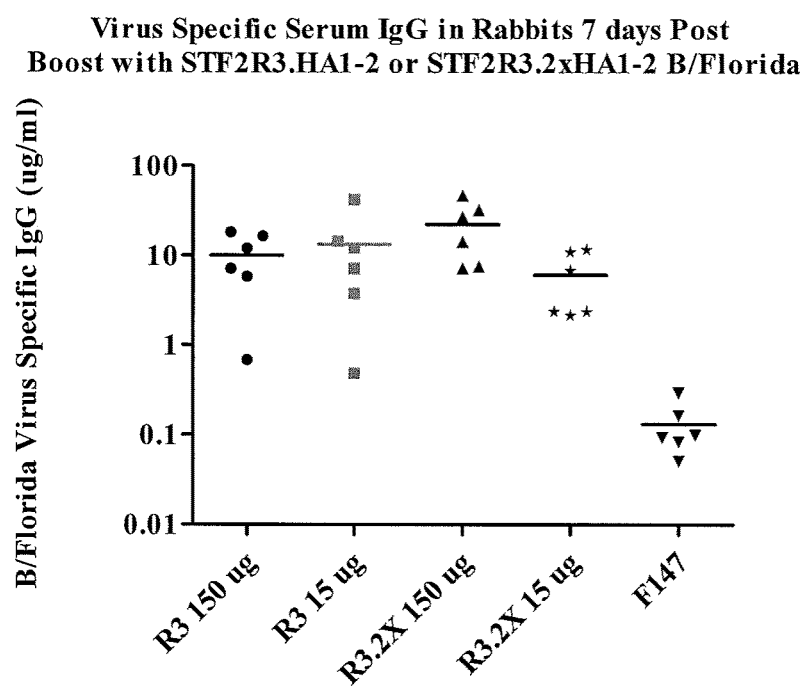
FIG. 15 depicts an evaluation of STF2R3.HA1-2 B FLA (R3) (SEQ ID NO: 470) and STF2R3.2x.HA1-2 B FLA (R3.2x) (SEQ ID NO: 471) immunogenicity. Groups of 6 rabbits were immunized twice i.m. with the indicated doses of vaccine. Sera were harvested 7 days post the booster dose and evaluated for virus specific IgG by ELISA. Data points represent results of individual animals while bars represent means.
Figure 16A:
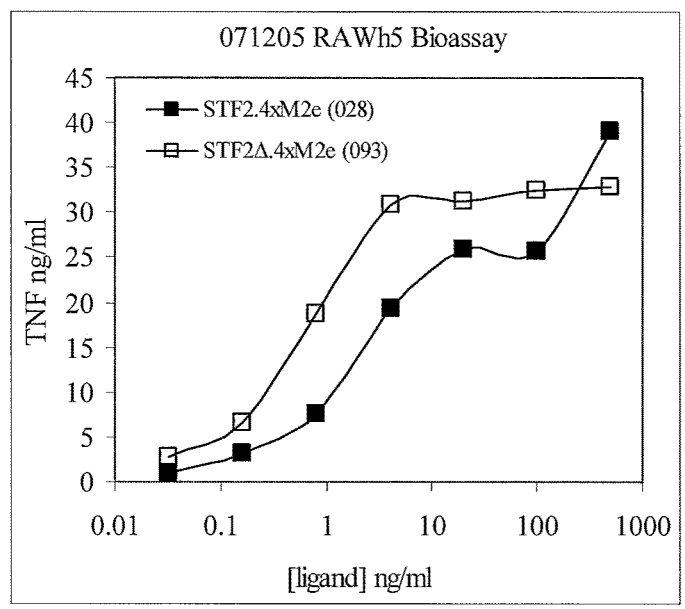
FIGS. 16A and 16B depict a comparison of STF2.4xM2e (SEQ ID NO: 457), STF2D2D3L.4xM2e (SEQ ID NO: 472), STF2.HA1-2 SI (SEQ ID NO: 463) STF2D2D3L.HA1-2 SI (SEQ ID NO: 473) TLR5 activity. TLR5-specific activity of fusion proteins was evaluated by measuring induction of TNF production. RAW/h5 cells were cultured overnight in 96-well microtiter plates. Cells were treated for 5 h with the indicated concentrations of protein. Supernatants were harvested and TNF expression was evaluated by ELISA. Absorbance is read and compared to a standard reference curve. Results are reported in ng/ml.
Figure 16B:
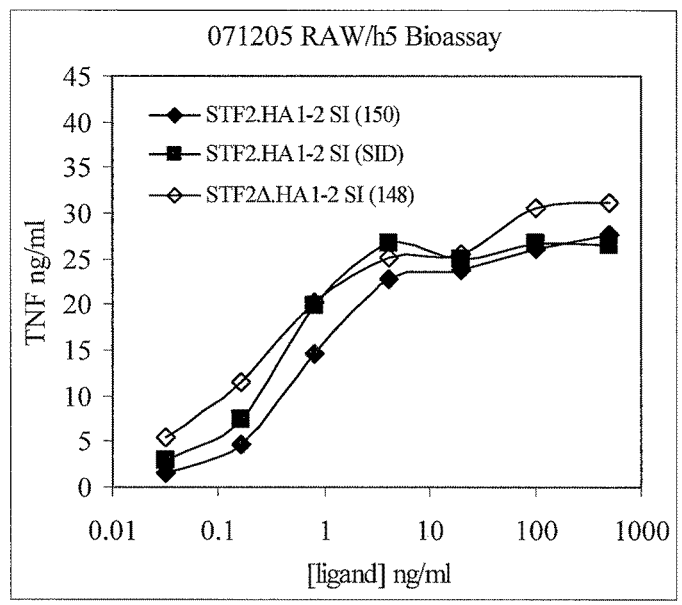
Figure 17A:
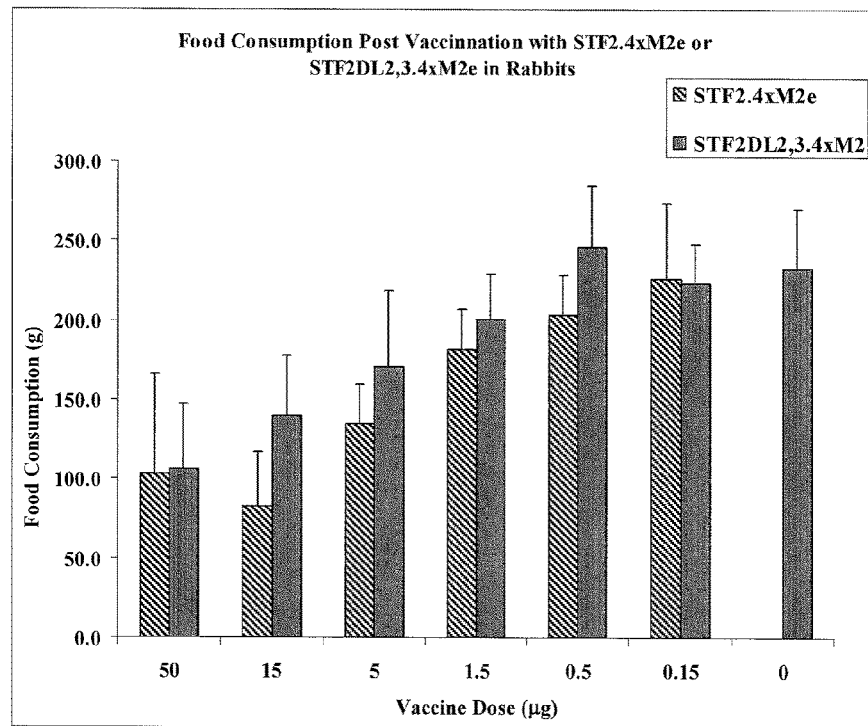
FIGS. 17A and 17B depict food consumption and CRP levels post-immunization with STF2.4xM2e (SEQ ID NO: 457) or STF2D2D3L.4xM2e (SEQ ID NO: 472).
Figure 17B:
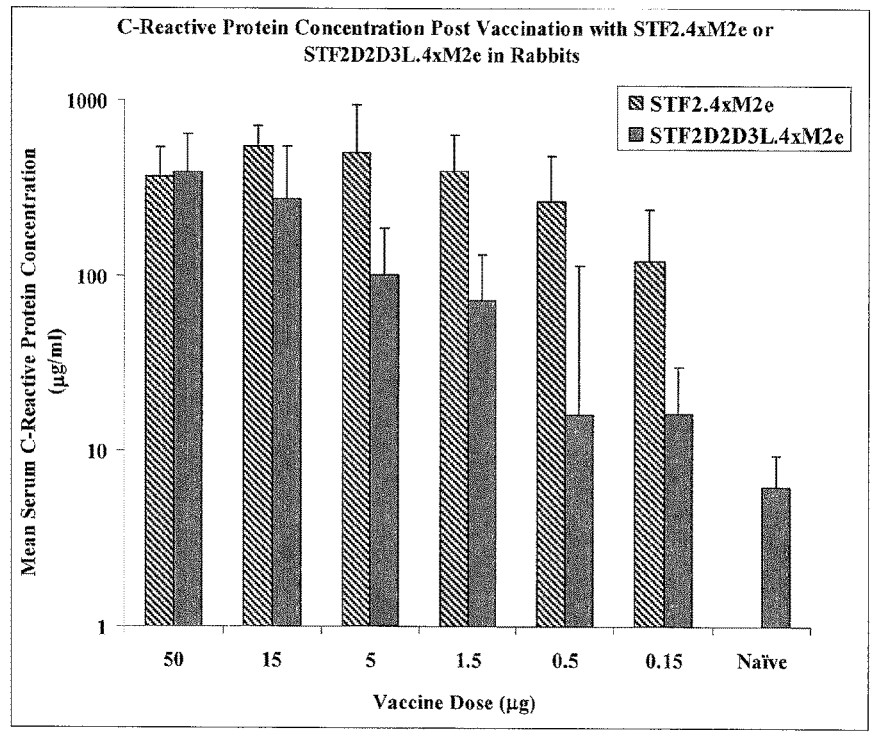

In the same experiment, rabbits were boosted on day 21 with the same construct. On day 28 sera were harvested and evaluated for Influenza B/Florida/4/2006 virus specific IgG. The results shown in FIG. 15, indicated that both constructs are immunogenic with only a modest reduction in the IgG titers for the minimally reactogenic R32x construct (SEQ ID NO: 471).

Conclusion

These data indicate that the principles of design developed for generating R3 and R32x constructs are generalizable. The reactogenicity profile of the vaccine can be substantially reduced by replacing domain 3 of flagellin with the vaccine antigen. The addition of a second vaccine antigen to the construct further improved the reactogenicity profile of the vaccine. For both the R3 and the 2x.R3 designs, the immunogenicity of the vaccine is retained and in some instances enhanced. Thus, the R3 and 2xR3 forms of flagellin provide a consistent improvement in the reactogenicity profile of the vaccine. These vaccines would have utility in instances where the subjects are naïve to the vaccine antigen or when the vaccine antigen is a poor immunogen and maximal immunopotency is required of the vaccine. An example of the former

Example 4

Vaccines Utilizing D2D3L Forms of Flagellin Provide Improved Reactogenicity Profiles with Low to Moderate Reductions in Immunogenicity Materials and Methods
Vaccine Design and Formulation Cloning of Recombinant Genes. Cloning of STF2.4xM2e (SEQ ID NO: 491):

Four tandem copies of M2e corresponding to the consensus sequence of the human influenza A virus (H1N1, H2N1, H3N2) was synthesized (DNA2.0, Menlo Park, Calif.) as a DNA concatemer (SEQ ID NO: 484). In this synthetic gene the eight cysteine residues (two per M2e copy) were modified to serine (SLLTEVETPIRNEWGSRSNDSSDPSR; SEQ ID NO: 507 to prevent disulfide bond formation that would be incompatible with *E. coli* expression. The plasmid DNA served as a template to generate the 4xM2e fusion gene employing the Seamless Cloning kit by Stratagene (LaJolla, Calif.).

The PCR product was ligated to the 3 prime end of the *S. typhimurium* fljB gene (STF2) in a pET24A vector (Novagen, San Diego, Calif.) and the ligation mix was used to transform XL1-Blue MRF' cells, and positive clones were identified by PCR screening using pET24Aspecific primers and by restriction mapping analysis. The construct, pET/STF2.4xM2e was confirmed by DNA sequencing. The plasmid DNA was used to transform competent BLR(DE3)pLysS cells and several transformants were picked and grown overnight for induction with 1 mM IPTG. About two hours after induction the bacteria were harvested and the lysate was analyzed by SDS-PAGE. A 67 kDa band corresponding to STF2.4xM2e protein was readily visible by Coommassie Blue staining and by immunoblot using the anti-M2 monoclonalantibody 14C2 (ABI Biosciences). A clone was selected. The 4xM2e gene was generated by PCR using pET/STF2.4xM2e as the template and employing NdeF1 (5_GAATTCCATATGAGCT-TGCTGACTGAGGTTGAGACCCCGATTCGCA; SEQ ID NO: 508 and BlpR (5_GACGTGGCTCAGCTTATTAATG-GTGATGATGGTGATGTCTAGACGGGTCT GAGC-TATCGTTAGAGCG; SEQ ID NO: 509) as forward and reverse primers, respectively. The 270 bp fragment was digested with NdeI and BlpI enzymes and inserted into pET24A vector that has been previously digested with the same enzymes. The construct, pET/4xM2e which contains a polyhistidine tag at the C-terminus of the M2e protein, was used to transform BLR DE3 cells as described above.

Cloning of STF2D2D3L.4xM2e (SEQ ID NO: 492):

Full length flagellin from *Salmonella typhimurium* fljb (flagellin phase 2) or STF2 is encoded by a 1.5 kb gene. A modified version of STF2, designated STF2.D2D3L (SEQ ID NO: 486), was generated by deleting the hypervariable region that spans amino acids 170 to 415. The deleted region was replaced with a short flexible linker (GAPVDPASPW; SEQ ID NO: 510) designed to retain interactions of the NH2 and COOH terminal regions necessary for TLR5 signaling. A synthetic 4xM2e gene (SEQ ID NO: 484) was fused to the C-terminus of STF2.D2D3L (SEQ ID NO: 486) to generate pET/STF2D2D3L.4xM2e (SEQ ID NO: 492).

Expression and Purification of Fusion Proteins:

The flagellin fusion proteins were manufactured utilizing a fed-batch fermentation process in *E. coli*. After complete exhaustion of the available glucose during the batch phase, four liters of enriched synthetic feed media was pumped at a controlled rate over an additional 10.5 hrs (for a total process time was 30.3 hrs). Expressions of the target protein were induced with 2.1 mM IPTG (final concentration). Cells were pelleted by centrifugation and cell paste was stored at −20° C. Cell paste was thawed and diluted to 15% solids in 50 mM Tris 25 mM NaCl (pH 8). The suspension was homogenized three times under 12 k PSI. STF2.4xM2e (SEQ ID NO: 457) was located in both supernatant and pellet. Only supernatant was processed. The majority of STF2D2D3L.4xM2e (SEQ ID NO: 472) was found in the pellet. Only the inclusion body was processed.

For the supernatant process, protein fractions containing the fusion protein were precipitated by either 10% polyethylene glycol (PEG) or by 4M $(NH_4)_2SO_4$. The pellets were dissolved in 8 M urea at pH 4 to solubilize the target protein. Soluble proteins were extracted in the supernatant phase by centrifugation. Supernatants were bound to a CEX column (Tosoh SP650M) in 6M Urea, low salt. The target proteins were eluted under NaCl step elution conditions. The collected proteins were refolded by rapid dilution using 20 mM Tris, 0.5M Urea, 0.1M Trehalose, 2 mM $CaCl_2$, 3 mM Cysteine, 0.3 mM Cystine, 1 mM EDTA, 0.1% PS-80, pH 8.0 with constant stirring overnight. The refolded proteins were concentrated to 1 liter and the buffer exchanged using 50 mM Tris, 0.05% PS80, 0.1 M Trehalose (pH 8). Q anion exchange chromatography was performed to remove remaining impurities. High protein containing, Q eluate peak fractions were selected for further processing. Size exclusion chromatography was performed as a final purification step to isolate the purified monomeric form of the target proteins. For the pellet process, the inclusion body was washed with 1% Triton X-100 and solubilized with 8M urea. The protein was refolded by the rapid dilution using the same condition. Further purification follows the same steps as the supernatant process. Final bulk protein was stored at −70° C. as 1 mL aliquots.

Residual endotoxin was assayed by using standard Chromogenic Limulus Amebocyte Lysate assay (Cambrex, Walkersville, Md.) as directed by the manufacturer. For the 6xHis tagged baculaovirus produced proteins, the metal chelating column was employed. Protein was loaded to a Ni-NTA column equilibrated in 20 mM Tris, pH 8, 0.5 M NaCl and eluted in a gradient of 0-0.5 M imidazole. The target protein was further purified by size exclusion column (10/300 GL, GE/Amersham). The peak fractions were pooled, concentrated and dialyzed against 1xPBS. Aliquoted protein solution was stored at −80° C.

Protein Characterization:

Proteins were characterized for purity, identity, endotoxin content, and biological activity using the following assays.

SDS-PAGE:

Proteins (typically 5 μg) were diluted in SDS-PAGE sample buffer (1% SDS, 30 mM Tris-HCl, pH 6.8, 4% glycerol, 0.1 mg/ml bromophenol blue) with and without 5 mM β-mercaptoethanol. The samples were boiled for 5 minutes and loaded onto a 4-20% SDS polyacrylamide gel. Following electrophoresis, gels were stained with coomassie blue to visualize protein bands.

Endotoxin Assay:

Endotoxin levels were measured using the QCL-1000 Quantitative Chromogenic LAL test kit (BioWhittaker #50-648U), following the manufacturer's instructions for the microplate method.

Protein Assay:

Protein concentrations were determined by the MicroBCA Protein Assay Reagent Kit in a 96-well format using BSA as a standard (Pierce Biotechnology), following the manufacturer's instructions.

Flagellin ELISA:

Protein integrity and concentration were examined by ELISA with antibodies specific for flagellin. ELISA plates (96-well) were coated overnight at about 4° C. with serial dilutions of each target protein, in PBS starting at 5 µg/ml. Plates were blocked with about 200 µl/well of Assay Diluent Buffer (ADB; BD Pharmingen) for one hour at room temperature then washed three times in phosphate-buffered saline containing Tween-20 (PBS-T, 12 mM $NaPO_4$, 137 mM NaCl, 2.7 mM KCl, 0.05% Tween 20). Rabbit polyclonal anti-flagellin antibody diluted in ADB (100 µl/well, 1:5000) was added to all wells and the plates were incubated for 1 hour at room temperature or overnight at 4° C., then washed three times with PBS-T. HRP-labeled goat anti-rabbit IgG antibody (Jackson Immunochemical) diluted in ADB was added (100 µl/well, 1:5000) and the plates were incubated at room temperature for 1 hour. The plates were washed three times with PBS-T. After adding TMB Ultra substrate (Pierce) and monitoring color development, $A_{450}$ was measured on a Tecan Farcyte microplate spectrophotometer.

TLR5 Bioassay:

The bioactivity of purified recombinant proteins was tested using an in vitro cell based assay. Briefly, RAW264.7 cells were obtained from ATCC (Rockville, Md.). This cell line expresses TLR2 and TLR4, but not TLR5. RAW264.7 cells were transfected with a plasmid encoding human TLR5 (Invivogen, San Diego, Calif.) to generate RAW/h5cells. TLR5-specific activity of fusion proteins was evaluated by measuring induction of TNF production. RAW/h5 cells were cultured in 96-well microtiter plates (Costar) at a seeding density of $(3-5) \times 10^4$ cells in 100 µl/well in DMEM medium supplemented with 10% FCS and antibiotics. The next day, cells were treated for 5 h with serial dilutions of test proteins starting at 5 µg/ml. At the completion of the assay, supernatants were harvested and TNF expression was evaluated by ELISA (Invitrogen, Carlsbad, Calif.). Absorbance and luminescence were evaluated using a TECAN microplate spectrophotometer running Magellan Software (Amersham).

Rabbit Reactogenicity and Immunogenicity Studies:

Animals:

Studies with female and male New Zealand White rabbits were performed at Covance Research Products (Denver, Pa.).

Reactogenicity Evaluations:

Rabbits (6/group) were immunized intramuscularly (i.m.) on days 0 and 21. Sera were harvested 1 day post the priming immunization for CRP measurements (CRP ELISA kit, Immunology Consultants Laboratory, Newberg, Oreg.). Food consumption was measured from day 0 to day 1.

ELISA:

ELISA plates were coated with M2e peptide or SI HA protein in PBS overnight at 4° C., blocked with 200-300 µl/well of Assay Diluent Buffer (ADB; BD Pharmingen, San Diego, Calif.) for 2-3 hours at 23-27° C. After incubation with the indicated detection antibodies, HRP-labeled goat anti-mouse antibody (Jackson Immunochemical, West Grove, Pa.) diluted in ADB was added and the plates were incubated at 23-27° C. for 1-2 hours. All washes between reagent addition steps were performed 3 times with 1×PBS/0.05% Tween-20. After adding TMB Ultra substrate (Pierce, Rockford, Ill.) and monitoring color development, the reaction was stopped with 1M $H_2SO_4$ and $OD_{450}$ was measured on a microplate spectrophotometer.

STF2.4xM2e (SEQ ID NO: 457) and STF2D2D3L.4xM2e (SEQ ID NO: 472) Immunogenicity and Efficacy Studies in Mice:

BALB/c mice 6-8 weeks old were purchased from the Jackson Laboratory (Bar Harbor, Me.). STF2.4xM2e (SEQ ID NO: 457) and STF2D2D3L.4xM2e (SEQ ID NO: 472) recombinant proteins were prepared as described above and formulate in one of two formulations, PBS (phosphate-buffered saline) or formula F105 (10 mM histidine, 75 mM NaCl, 5% sucrose, 0.02% polysorbate 80, 0.1 mM EDTA, 0.5% ethanol, 10 mM Tris, pH 7.2). Formulations were used interchangeably without detectable impact on the results. To assess efficacy, mice immunized on days 0 and 14 as described above were challenged on day 28 by intranasal administration of an LD90 (dose lethal to 90% of mice; 8×103EID) of influenza A isolate PR8. Animals were monitored daily for 21 days following the challenge for survival.

Results and Discussion

Relative TLR5 Activity of Fusions to Full Length and D2D3L Forms of Flagellin:

Purified STF2.4xM2e (SEQ ID NO: 457) STF2D2D3L.4xM2e (SEQ ID NO: 472) STF2.HA1-2 SI (SEQ ID NO: 463) and STF2D2D3L.HA1-2 SI (SEQ ID NO: 473) fusion proteins were evaluated for TLR5-specific bioactivity using the RAW/h5 cell line. Serial dilutions of the proteins were incubated with the RAW/h5 cells overnight. RAW supernatants were assayed for TNF levels. Both the M2e antigen (4xM2e; SEQ ID NO: 485) and the HA1-2 SI antigen (SEQ ID NO: 499) fused to the D2D3L form of flagellin (also referred to as "STF2Δ" or "STF2 delta") exhibited potent TLR5-specific stimulatory activity that was comparable to the same antigen fused to the full length flagellin construct (FIGS. 16A and B). The resulting fusion proteins are (SEQ ID NO: 472) (STF2Δ.4xM2e) and (SEQ ID NO: 473) (STF2Δ.HA1-2(SI)).

Comparative Reactogenicity of STF2.4xM2e (SEQ ID NO: 457) and STF2D2D3L.4xM2e (SEQ ID NO: 472):

The reactogenicity of the STF2.4xM2e (SEQ ID NO: 457) and STF2D2D3L.4xM2e (SEQ ID NO: 472) proteins was examined in the rabbit model. Groups of six rabbits were immunized with doses ranging from 0.15 to 50 μg. Food consumption was measured for 24 hours following immunization. Rabbits were bled the day before and 1 day after immunization for determination of serum CRP levels using a commercial kit (Immunology Consulting Laboratories, Newberg Oreg.).

As shown in FIGS. 17A and 17B both constructs demonstrate dose-dependent effects on food consumption and CRP levels. However, the comparative results indicate that the STF2.4xM2e (SEQ ID NO: 457) construct which involves fusion of the antigen to the C terminus of full length flagellin, causes a stronger reactogenic response than STF2D2D3L.4xM2e (SEQ ID NO: 472). Immunization with the C-terminal fusion causes a greater loss of appetite and drives a higher increase in CRP than the equivalent dose of STF2D2D3L.4xM2e (SEQ ID NO: 472).

Comparative Immunogenicity and Efficacy of STF2.4xM2e (SEQ ID NO: 457) and STF2D2D3L.4xM2e (SEQ ID NO: 472):

The immunogenicity of the STF2.4xM2e (SEQ ID NO: 457) and STF2D2D3L.4xM2e (SEQ ID NO: 472) proteins was examined in BALB/c mice (10/group) immunized s.c. on day 0 and 14 with PBS, STF2.4xM2e (SEQ ID NO: 457) (3 μg) or STF2D2D3L.4xM2e (SEQ ID NO: 472) (3 or 0.3 μg). On day 21 mice were bled and M2e-specific IgG responses were examined by ELISA. The results in FIGS. 18A and B demonstrate that immunization with 3 or 0.3 μg of

Figure 18A:
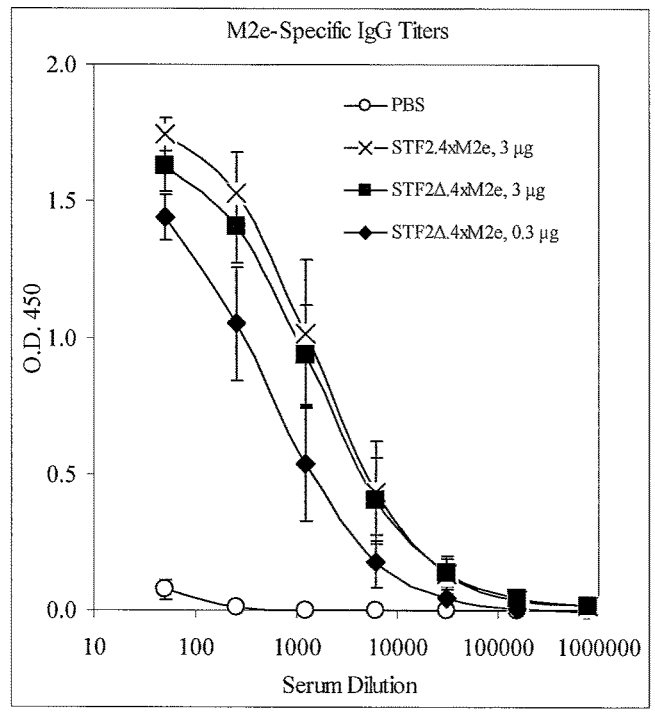
FIGS. 18A and 18B depict immunogenicity and Efficacy of STF2.4xM2e (SEQ ID NO: 457) and STF2D2D3L.4xM2e (SEQ ID NO: 472). Groups of BALB/c mice (n=10) were immunized on days 0 and 14 with the indicated doses of STF2.4xM2e (SEQ ID NO: 457) or STF2D2D3L.4xM2e (or STF2Δ.4xM2e) (SEQ ID NO: 472). Sera were collected 7 days post the booster dose and tested for M2e specific IgG by ELISA (FIG. 18A). On day 28 mice were challenged with 1xLD90 of PR8 virus. Mice were monitored for survival for 21 days post the challenge (FIG. 18B).
Figure 18B:
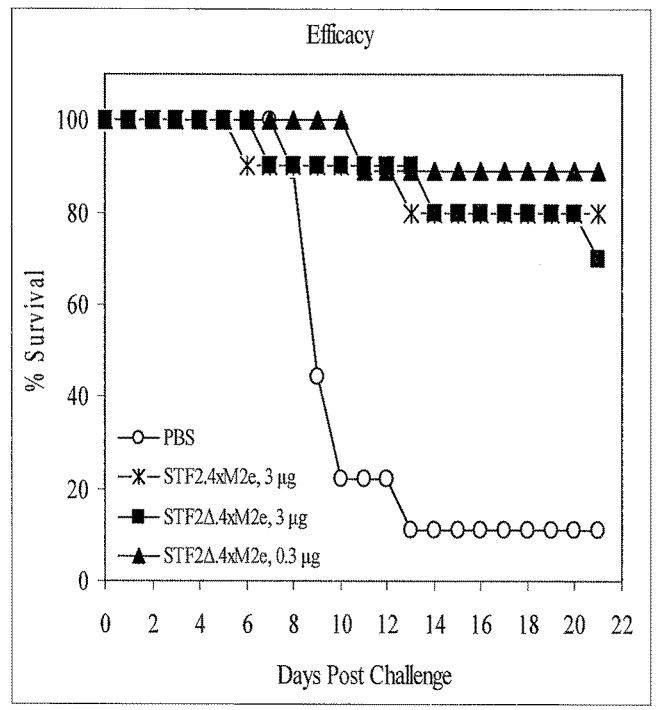

STF2D2D3L.4xM2e (SEQ ID NO: 472) induced M2e-specific IgG responses, with the higher dose demonstrating responses comparable to those induced by the same dose of STF2.4xM2e (SEQ ID NO: 457). On day 28, the mice in this study were challenged with an $LD_{90}$ of PR/8 ($8\times10^3$ EID (Egg Infectious Doses)) to evaluate efficacy in vivo. As shown in FIGS. 18A and 18B, mice immunized with PBS alone exhibited 10% survival while mice immunized with the STF2.4xM2e (SEQ ID NO: 457) demonstrated 80% survival. Mice immunized with 3 or 0.3 µg of STF2D2D3L.4xM2e (SEQ ID NO: 472) demonstrated 90 and 80% survival, respectively, that was comparable to that observed to animals receiving STF2.4xM2e (SEQ ID NO: 457). Thus, it appears that deletion of the D2 and D3 domains of flagellin does not negatively impact immunogenicity of the fused 4xM2e antigen or efficacy of the vaccine construct.

Comparative Reactogenicity and Immunogenicity Profiles for the H1N1 Constructs STF2.HA1-2 SI (SEQ ID NO: 463) and STF2D2D3L.HA1-2 SI (SEQ ID NO: 473):

The C-terminal fusion molecule STF2.HA1-2 SI (SEQ ID NO: 463) was compared to STF2D2D3L.HA1-2 SI (SEQ ID NO: 473) in the rabbit model, to determine reactogenicity. Six rabbits per group were immunized i.m. with 50, 15, 5, 1.5 and 0.5 µg of either STF2.HA1-2 SI (SEQ ID NO: 463) or STF2D2D3L.HA1-2 SI (SEQ ID NO: 473). Food consumption was measured for 24 hours following the immunization. Rabbits were bled the day before and 1 day after immunization for determination of serum CRP levels using a commercial kit (Immunology Consulting Laboratories, Newberg Oreg.).

Figure 19A:
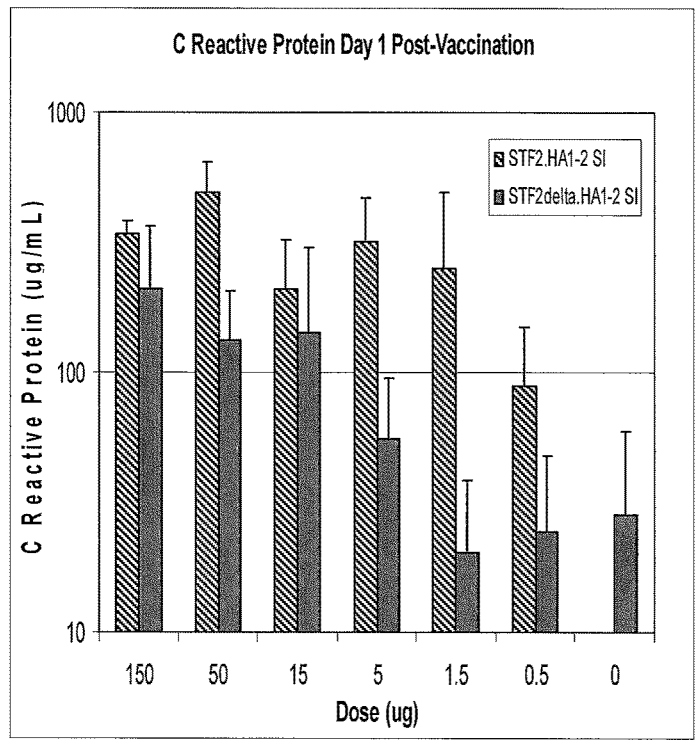
FIGS. 19A and 19B depict CRP and food consumption post-immunization with STF2.HA1-2 SI (SEQ ID NO: 463) versus STF2D2D3L.HA1-2 SI (SEQ ID NO: 473).
Figure 19B:
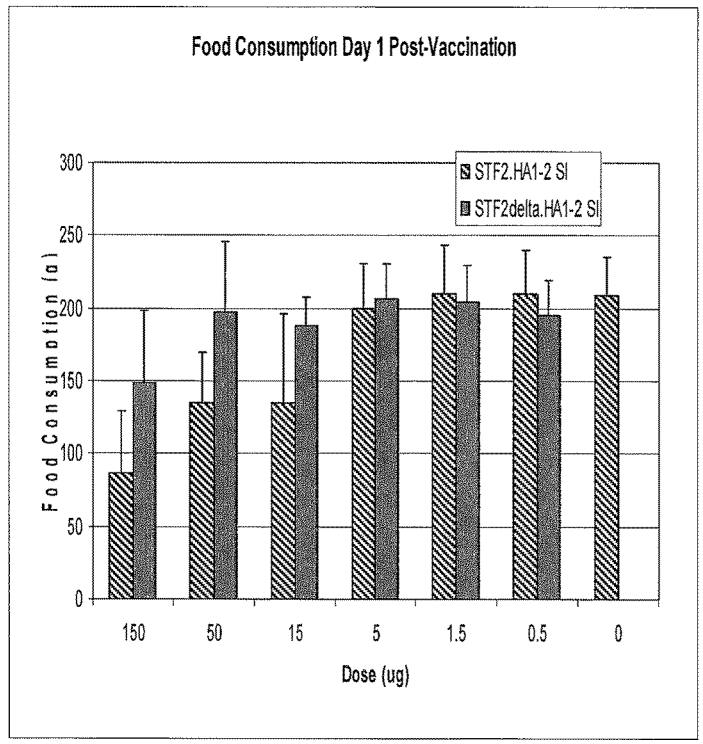

As shown in FIGS. 19A and B, while both constructs demonstrate dose-dependent effects on food consumption, temperature and CRP levels, the comparative results indicate that the STF2.HA1-2 PR8 (SEQ ID NO: 460) construct which involves fusion of the antigen to the C terminus of full length flagellin, causes a stronger reactogenic response than STF2R3.HA1-2 PR8 (SEQ ID NO: 464). Immunization with the C-terminal fusion drives a higher increase in body temperature and CRP and causes a greater loss of appetite than the equivalent dose of STF2R3.HA1-2 PR8 (SEQ ID NO: 464).

Figure 20:
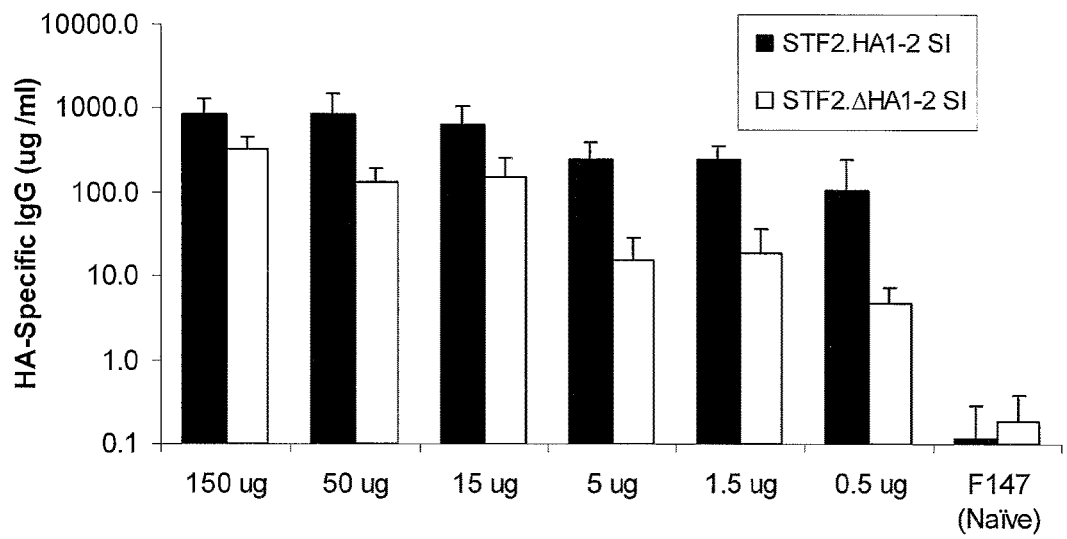
FIG. 20 depicts Solomon Islands HA specific IgG responses post-immunization with STF2.HA1-2 SI (SEQ ID NO: 463) versus STF2D2D3.HA1-2 SI (SEQ ID NO: 473). CRP levels were measured 24 hours after the immunization. Data is presented as mean CRP levels±standard deviation for 6 rabbits per group.

On day 21 of the same study rabbit sera was harvested and tested for SI specific IgG responses. The results in FIG. 20 demonstrate that immunization with STF2D2D3.HA1-2 SI (SEQ ID NO: 473) induced lower SI HA-specific IgG responses that ranged from about 10 fold less at the lower doses and about 2 to about 5 fold less at the higher doses.

Example 5

H1 HA Globular Head Vaccines Utilizing R0 Forms of Flagellin Provide Limited Reactogenicity and Low to Moderate Immunogenicity Materials and Methods
Vaccine Design and Formulation
Cloning of Recombinant HA Genes:
For construction of the STF2R0.HA1-2 (PR8) gene (SEQ ID NO: 493) a two-step PCR reaction was used to delete domain D0 of STF2.HA1-2 (PR8). In the first step, DNA from pET24a-STF2.HA1-2 PR8 (SEQ ID NO: 458) was used as a DNA template, and primers were used to amplify STF2 without domain 0 and HA1-2 (PR8) respectively. In the second step, the two PCR fragments from the first step were gel purified and used as DNA templates and primers used for this $2^{nd}$-step overlapping PCR reaction. The final PCR product was digested with NdeI and EcoRI, gel purified and ligated by compatible ends to pET24a to generate the STF2R0.HA1-2 PR8 construct (SEQ ID NO: 493).

Expression and Purification of HA Globular Head-Flagellin Fusion Proteins:

Flagellin fusion proteins were manufactured utilizing a fed-batch fermentation process in *E. coli*. After complete exhaustion of the available glucose during the batch phase, four liters of enriched synthetic feed media was pumped at a controlled rate over an additional 10.5 hrs (for a total process time was 30.3 hrs). Expression of the target proteins was induced with 2.1 mM IPTG (final concentration). Cells were pelleted by centrifugation and cell paste was stored at −20° C. Cell paste was thawed and diluted to 15% solids in 50 mM Tris 25 mM NaCl (pH 8). The suspension was homogenized three times under 12 k PSI. The inclusion body was processed. The pellets were dissolved in 8 M urea at pH 4 to solubilize the target protein. Soluble proteins were extracted in the supernatant phase by centrifugation. Supernatants were bound to a CEX column (Tosoh SP650M) in 6M Urea, low salt. The target proteins were eluted under NaCl step elution conditions. The collected proteins were refolded by rapid dilution using 20 mM Tris, 0.5M Urea, 0.1M Trehalose, 2 mM $CaCl_2$, 3 mM Cysteine, 0.3 mM Cystine, 1 mM EDTA, 0.1% PS-80, pH 8.0 with constant stirring overnight. The refolded proteins were concentrated to 1 liter and the buffer exchanged using 50 mM Tris, 0.05% PS80, 0.1 M Trehalose (pH 8). Q anion exchange chromatography was performed to remove remaining impurities. High protein containing, Q eluate peak fractions were selected for further processing. Size exclusion chromatography was performed as a final purification step to isolate the purified monomeric form of the target proteins. For the pellet process, the inclusion body was washed with 1% Triton X-100 and solubilized with 8M urea. The protein was refolded by the rapid dilution using the same condition. Further purification follows the same steps as the supernatant process. Final bulk protein was stored at −70° C. as 1 mL aliquots. Residual endotoxin was assayed by using standard Chromogenic Limulus Amebocyte Lysate assay (Cambrex, Walkersville, Md.) as directed by the manufacturer. Aliquoted protein solution was stored at −80° C.

Protein Characterization:
Proteins were characterized for purity, identity, endotoxin content, and biological activity using the following assays.
SDS-PAGE:
Proteins (typically 5 µg) were diluted in SDS-PAGE sample buffer (1% SDS, 30 mM Tris-HCl, pH 6.8, 4% glycerol, 0.1 mg/ml bromophenol blue) with and without 5 mM β-mercaptoethanol. The samples were boiled for 5 minutes and loaded onto a 4-20% SDS polyacrylamide gel. Following electrophoresis, gels were stained with coomassie blue to visualize protein bands.

Endotoxin Assay:
Residual endotoxin was assayed by using standard Chromogenic Limulus Amebocyte Lysate assay (Cambrex, Walkersville, Md.) as directed by the manufacturer.

Protein Assay:
Protein concentrations were determined by the MicroBCA Protein Assay Reagent Kit in a 96-well format using BSA as a standard (Pierce Biotechnology), following the manufacturer's instructions.

Flagellin ELISA:
Protein integrity and concentration were examined by ELISA with antibodies specific for flagellin. ELISA plates (96-well) were coated overnight at 4° C. with serial dilutions of each target protein, in PBS starting at 5 µg/ml. Plates were blocked with 200 µl/well of Assay Diluent Buffer (ADB; BD Pharmingen) for one hour at room temperature then washed three times in phosphate-buffered saline containing Tween-20 (PBS-T, 12 mM NaPO$_4$, 137 mM NaCl, 2.7 mM KCl, 0.05% Tween 20). Rabbit polyclonal anti-flagellin antibody diluted in ADB (100 μl/well, 1:5000) was added to all wells and the plates were incubated for 1 hour at room temperature or overnight at 4° C., then washed three times with PBS-T. HRP-labeled goat anti-rabbit IgG antibody (Jackson Immunochemical) diluted in ADB was added (100 μl/well, 1:5000) and the plates were incubated at room temperature for 1 hour. The plates were washed three times with PBS-T. After adding TMB Ultra substrate (Pierce) and monitoring color development, $A_{450}$ was measured on a Tecan Farcyte microplate spectrophotometer.

TLR5 Bioactivity Assay:

HEK293 cells (ATCC, Cat #CRL-1573, Manassas, Va.) constitutively express TLR5, and secrete several soluble factors, including IL-8, in response to TLR5 signaling. Cells were seeded in 96 well microplates (50,000 cells/well), and recombinant test proteins were added. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce; Rockford, Ill., #M801E and #M802B) following the manufacturer's instructions. Optical density was measured using a microplate spectrophotometer.

Vaccine Evaluation

Immunogenicity and Efficacy Studies in Mice:

BALB/c mice 6-8 weeks old were purchased from the Jackson Laboratory (Bar Harbor, Me.) and housed in the Princeton University vivarium (Princeton, N.J.). All studies were performed in accordance with the University Institutional Animal Care and Use Committees (IACUC). Recombinant proteins were prepared in formula F147 (10 mM L-histidine, 150 mM NaCl, 5% trehalose, 0.02% polysorbate 80, 0.1 mM EDTA, 0.5% ethanol, 10 mM Tris, pH 7.2). Mice were immunized subcutaneously (s.c.) on days 0 and 14. On days 13 (primary) and 21 (boost), individual mice were bled by retro-orbital puncture. Sera were harvested by clotting and centrifugation of the heparin-free blood samples. To assess efficacy, mice immunized on days 0 and 14 as described above were challenged on day 35 by intranasal administration of 1×LD$_{90}$ (dose lethal to 90% of mice; 1×10$^3$TCID50 of influenza A isolate, PR8. Animals were monitored daily for 21 days following the challenge for survival and weight loss.

Reactogenicity and Immunogenicity Studies in Rabbits:

Studies with female and male New Zealand White rabbits were performed at Covance Research Products (Denver, Pa.). Rabbits (6/group) were immunized intramuscularly (i.m.) on days 0 and 21. Sera were harvested 1 day post the priming immunization for CRP measurements and 3 weeks post the booster dose for HA specific IgG measurements.

Results and Discussion

The data described herein, show that the flagellin of *Salmonella typhimurium* type 2 (STF2) is associated with dose-dependent reactogenicity in humans and rabbits. This is observed as a raise in body temperature and C reactive protein (CRP) in both species, nausea in humans and reduced food consumption in rabbits. This is almost certainly linked to the TLR5 activity of STF2, which can measured in an in vitro cytokine release assay. Immunogenicity, as measured as IgG specific for the fused vaccine antigen, has also been found to be dose-dependent such that group means of reactogenicity and immunogenicity can be modeled in a roughly linear correlation. In our initial attempt to improve the immunopotency of an H5 HA globular head vaccine (Example 1) deletions and replacements of selected domains of flagellin were created through manipulations of the recombinant gene sequence. The molecule STF2R0.HA1-2 VN (SEQ ID NO: 453), in which domain D0 was replaced with the globular head of HA from influenza H5N1 VN04 was found to be poorly immunogenic and efficacious in a mouse lethal challenge model (Example 1, FIGS. 5, 6A and 6B). The poor immunogenicity/efficacy in mice is likely the consequence of the greatly diminished TLR5 stimulatory activity associated with this construct (Example 1, Table 7).

In a separate set of studies, deletions and replacements of the D0 and D3 domains of STF2 were created through manipulations of the gene sequence for the H1N1 PR8/34 globular head gene fused to flagellin (SEQ ID NO: 460). The constructs were expressed, protein purified and then evaluated in both the TLR5 assay and in the established rabbit model for reactogenicity and immunogenicity. The molecule STF2R0.HA1-2 PR8 (SEQ ID NO: 474), in which the D0 domain was replaced with the globular head of HA from influenza H1N1 PR8/34, produced an unexpected result. Consistent with the VN04 R0 results the PR8/34 R0 had low TLR5 stimulatory activity. Reactogenicity was also found to be low; but surprisingly, the immunogenicity at medium and high doses was equivalent to the native STF2 linked to PR8 HA (STF2.HA1-2 PR8) (SEQ ID NO: 460) in this rabbit model. This may allow for safe delivery of higher doses of a flagellin-based vaccine in humans.

Figure 21:
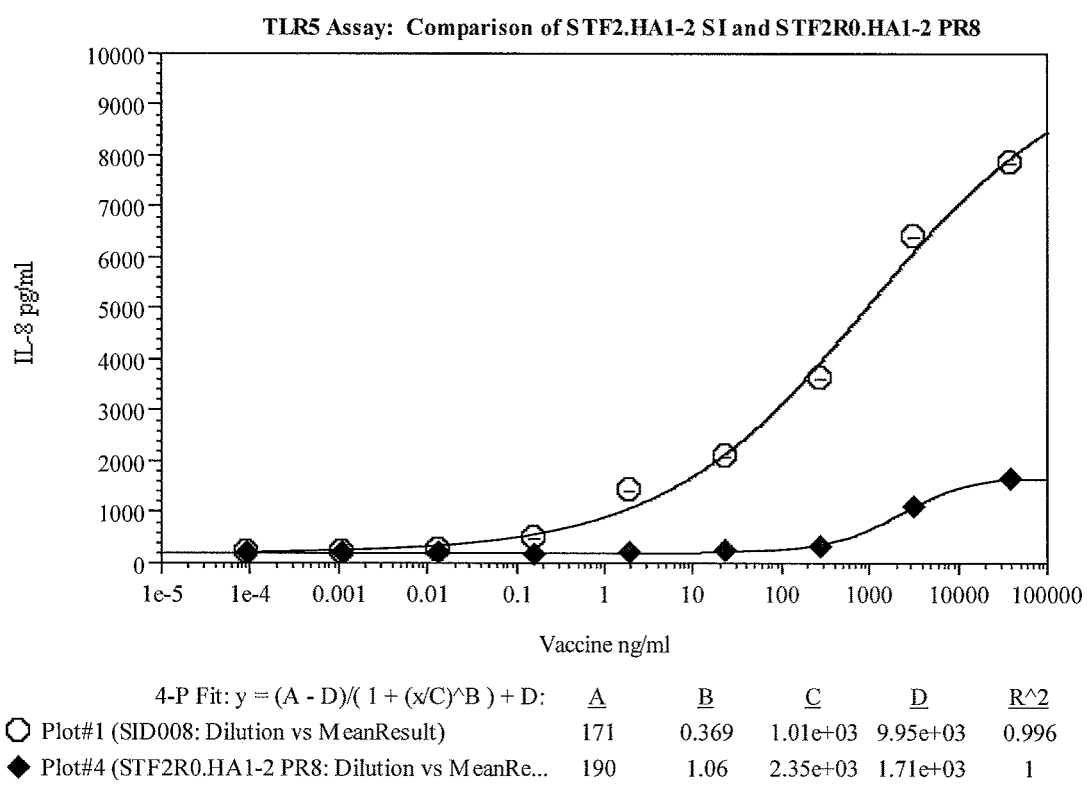
FIG. 21 depicts STF2R0.HA1-2 PR8 TLR5 Activity. Fusion proteins STF2R0.HA1-2 PR8 (SEQ ID NO: 474) and STF2.HA1-2 SI (SEQ ID NO: 463) (open circles) were diluted to the indicated concentrations and mixed with HEK293 cells. Supernatant was collected 24 hours later and analyzed for IL-8 using a sandwich ELISA (BD Pharmingen).

In Vitro Analysis of STF2R0.HA1-2 PR8 (SEQ ID NO: 474) TLR5 Stimulatory Activity:

HEK 293 cells (ATCC) were cultured in 96-well microtiter plates (Costar) at a seeding density of about 3 to about 5×10$^4$ cells in 100 μl/well in DMEM medium supplemented with 10% FCS and antibiotics. The next day, cells were treated for 5 hours with serial dilutions of test proteins. STF2.R0.HA1-2 PR8 (SEQ ID NO: 474) was compared to the reference protein STF2.HA1-2 SI, which is the Solomon Islands HA globular head fused to full length flagellin (SEQ ID NO: 461). At the completion of the assay, supernatants were harvested and IL-8 expression was evaluated by ELISA (Invitrogen, Carlsbad, Calif.). OD$_{450}$ was measured on a microplate spectrophotometer (Molecular Devices-MDS, Sunnyvale, Calif.). The results shown in FIG. 21 show that relative to the full length flagellin fusion construct, the STF2R0.HA1-2 PR8 protein (SEQ ID NO: 474) has low TLR5 stimulatory activity.

Immunogenicity and Reactogenicity Testing of STF2R0.HA1-2 PR8:

The relative immunogenicity and reactogenicity of STF2R0.HA1-2 PR8 (SEQ ID NO: 474) was compared to STF2.HA1-2 PR8 using the rabbit reactogenicity model. Doses of 150, 15 and 1.5 μg of STF2.HA1-2 PR8 were compared to the equivalent mass-adjusted doses of 132.1, 13.2 and 1.32 μg of STF2R0.HA1-2 PR8 (SEQ ID NO: 474). A formulation control was also included. Immunization was performed i.m. on days 0 and 21. Food consumption was measured from study days −1 to +3. Body temperature was measured rectally on days −1 to +3 as well. On day 0, temperature was measured 6 hours after immunization. Blood was collected and serum prepared on days −1 (prebleed), +1, 21, 22, 28 and 42. C reactive protein (CRP) was determined using a commercial ELISA (Immunological Consultants Laboratories, Oregon). PR8 HA-specific IgG was determined using a virus ELISA. Plates were coated with PR8 virus (205 HAU/mL) alongside a standard curve of polyclonal IgG (Serotec, Raleigh, N.C.). After washing and blocking, dilutions of serum were bound to the plate coated-virus. After further washing, specific IgG is detected using goat anti-rabbit IgG-HRP, TMB and H$_2$SO$_4$. Plates are read at 450 nm and specific IgG is calculated in µg/mL using the standard curve fit with a 4-parameter logistic equation (Softmax 5.2, Molecular Devices, Calif.).

Figure 22A:
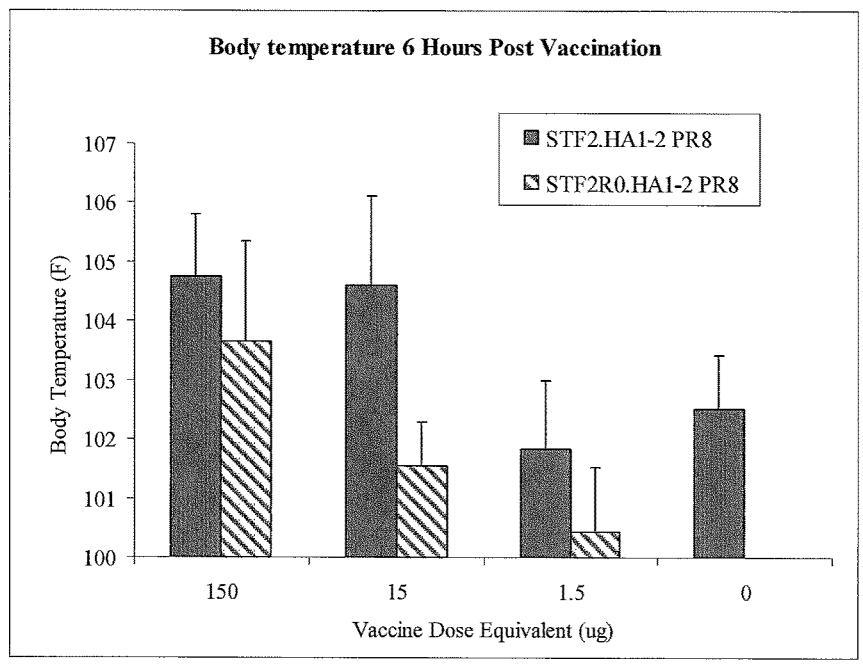
FIGS. 22A-22C depict reactogenicity of STF2R0.HA1-2 PR8 (SEQ ID NO: 474) compared to STF2.HA1-2 PR8 (SEQ ID NO: 460). Rabbits (6 per group) were immunized i.m. with the indicated dose equivalents on Day 0.
Figure 22B:
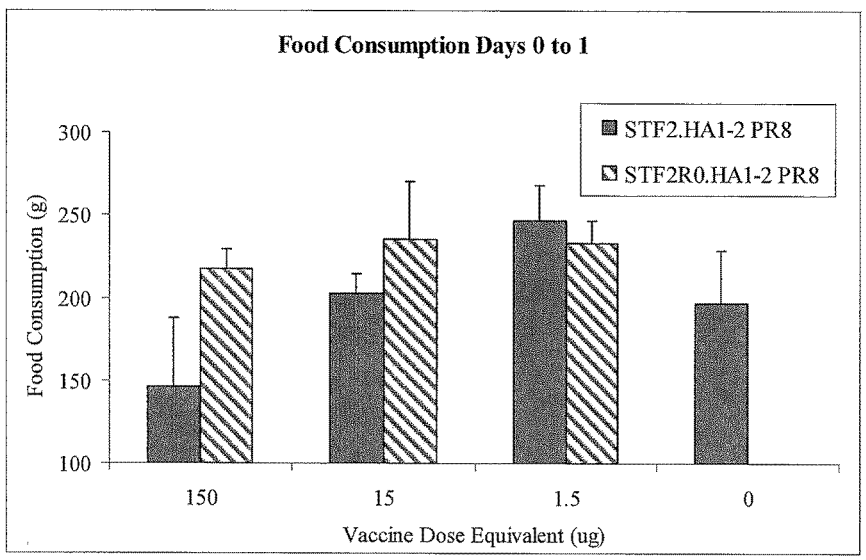
Figure 22C:
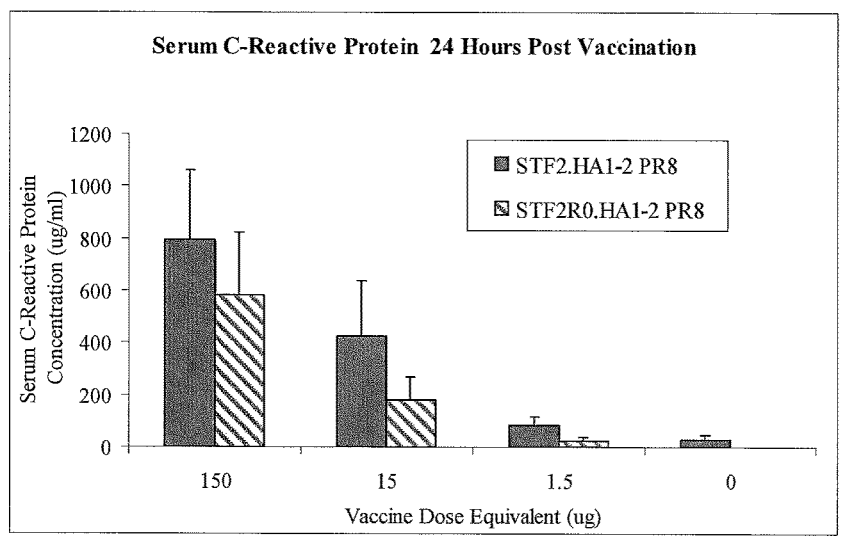
Figure 23:
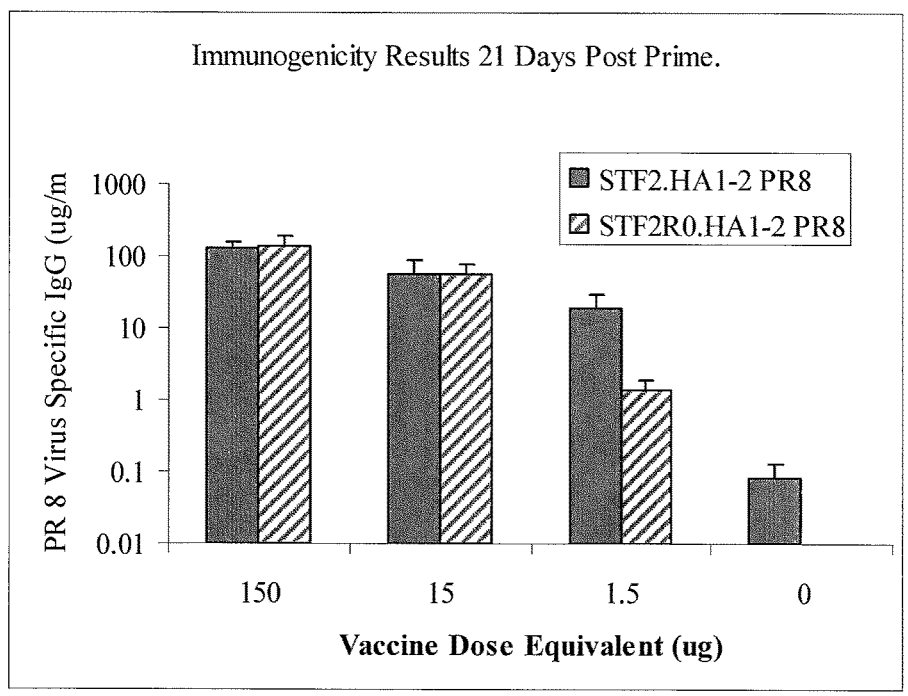
FIG. 23 depicts PR8-specific IgG after immunization with STF2R0.HA1-2 PR8 (SEQ ID NO: 474) compared to STF2.HA1-2 PR8 (SEQ ID NO: 460). Rabbits (6 per group) were immunized i.m. with the indicated dose equivalents no Day 0. They were bled on Day 21 and serum was analyzed for IgG to PR8 virus. ELISA plates were coated with virus (205 HAU/mL) alongside a standard curve of polyclonal IgG. Virus-specific IgG was calculated using a standard curve fit with a 4-parameter logistic equation. Data are presented as group mean IgG (µg/mL)±standard deviation.
Figure 24A:
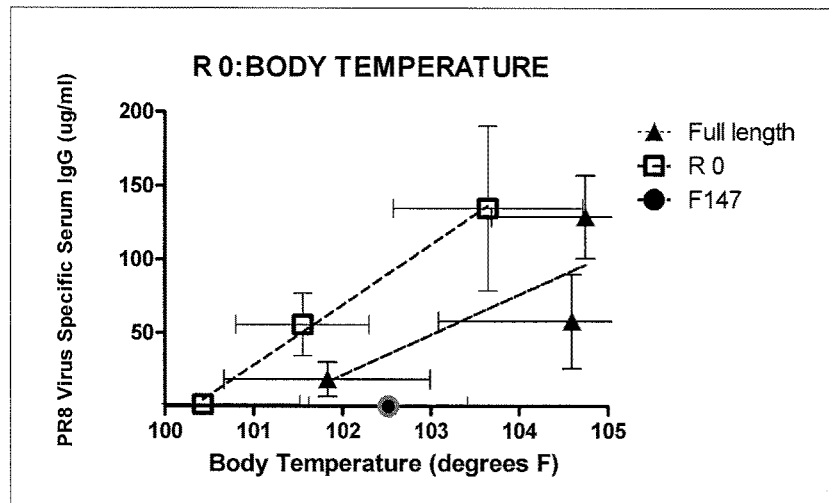
FIGS. 24A-24C depict Reactogenicity/Immunogenicity Ratio of STF2R0.HA1-2 PR8 (R0) (SEQ ID NO: 474) compared to STF2.HA1-2 PR8 (Full Length) (SEQ ID NO: 460). PR8-specific IgG (X-axis) is plotted against reactogencity measures.
Figure 24B:
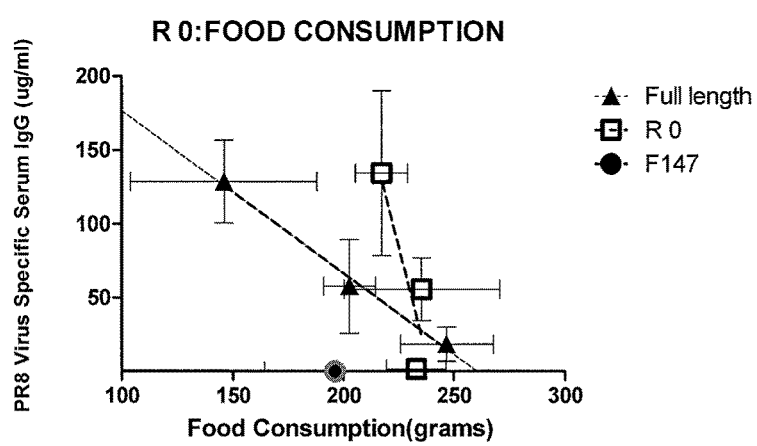
Figure 24C:
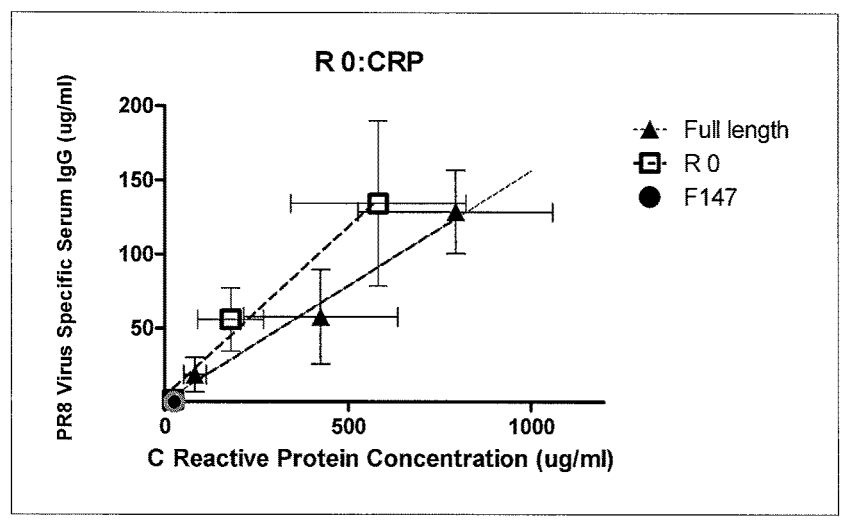
Figure 25:
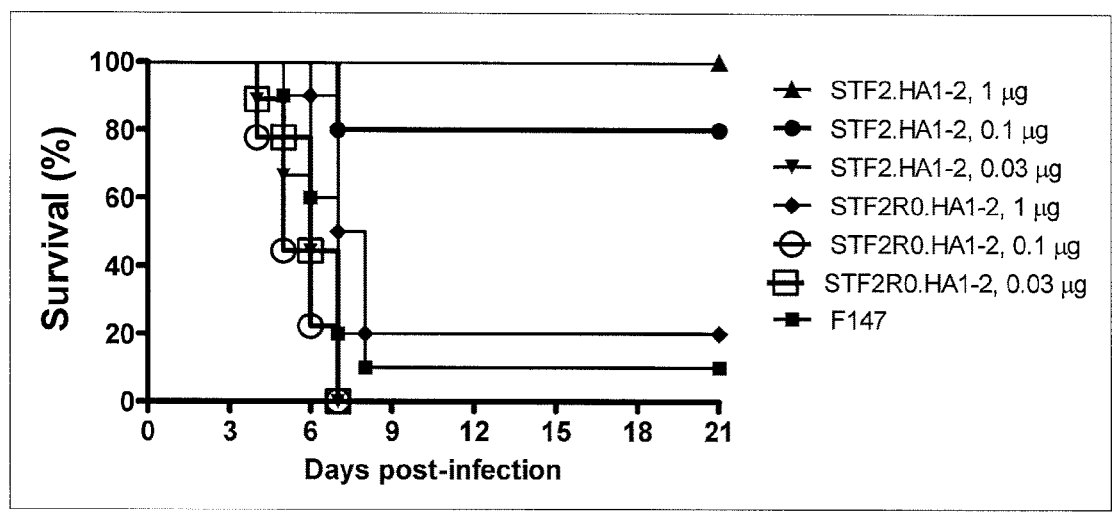
FIG. 25 depicts survival of vaccinated mice following change with A/PR/8/34 virus Groups of 10 BALB/c mice were immunized S.C. with STF2.HA1-2 PR8 (SEQ ID NO: 460), STF2R0.HA1-2 PR8 (SEQ ID NO: 474), or F147 buffer at the indicated does on days 0 and 14, and challenged i.n. (intranasally) with LD90 of A/PR/8/34 on day 34. The animals were observed daily for weight loss and mortality for 21 days.

Measures of food consumption, body temperature and CRP are considered together in a reactogenicity profile. The wild type flagellin found in STF2.HA1-2 PR8 (SEQ ID NO: 460) administered to rabbits at doses equal to or greater than 50 µg reduces eating and increases temperature and secretion of CRP, an acute phase protein made in the liver. These results are consistent with observations in a clinical trial of STF2.4xM2e (SEQ ID NO: 457), which contains the same flagellin sequence. As shown in FIGS. 22A through C, replacement of domain 0 of STF2 with HA1-2 (SEQ ID NO: 474) significantly reduces the reactogenicity profile at equivalent doses. Most notably, food consumption is largely unaffected by even 132.1 µg of STF2R0.HA1-2 PR8 (SEQ ID NO: 474) which is the molar equivalent of 150 µg of STF2.HA1-2 PR8 (SEQ ID NO: 460).

Despite the reduced reactogenicity of the R0 (SEQ ID NO: 474) construct, virus-specific IgG was found to be the same as that induced by wild type STF2.HA1-2 (SEQ ID NO: 460) at the 150 and 15 μg equivalent doses, as shown in FIG. 23. At the 1.5 μg equivalent dose native STF2.HA1-2 PR8 (SEQ ID NO: 460) produces a higher anti-PR8 titer than STF2R0.HA1-2 PR8 (SEQ ID NO: 474).

As shown in FIGS. 24A through C, plotting PR8-specific IgG compared to each of the reactogenicity measures provides a unique visual representation of the differences between the wild type and R0 molecules. In particular, R0 slopes of the best fit lines on each of the plots are different than STF2. This has not been observed with any of the other STF2 variants assessed in which the reactogenicity and IgG measures have moved in parallel so that the slopes remain similar. Given the superior reactogenicity profile of R0, it appears that higher doses of STF2R0.HA1-2 (SEQ ID NO: 474) may be tolerated in humans in which case equivalent or even higher titers might be achieved without side effects.

Efficacy of STF2R0.HA1-2 PR8 (SEQ ID NO: 474) in Mice:

The protective efficacy of STF2.HA1-2 PR8 and STF2R0.HA1-2 PR8 was compared in a mouse lethal challenge model. BALB/c mice were immunized with the two antigens at three different doses at a 2-week interval, and challenged with A/PR8/34. As shown in FIG. 25, immunizations with 0.03, 0.1, and 1 μg of STF2.HA1-2 PR8 resulted in 20%, 80%, and 100% survival. In contrast, only 20% of mice immunized with the highest dose (1 μg) of STF2R0.HA1-2 PR8 (SEQ ID NO: 474) survived the lethal viral challenge.

These results confirm that, in contrast to rabbits, in mice the R0 construct (SEQ ID NO: 474) is poorly immunogenic, but may be useful in compositions to prevent or ameliorate infection in which a subject is immunologically naïve.

Conclusion

While the R0 (SEQ ID NO: 474) construct is poorly immunogenic and efficacious in mice, in the rabbit model the construct is immunogenic with only modest reductions in immunopotency being observed at the lower doses tested. Because the rabbit model has successfully predicted the therapeutic window for two separate vaccines evaluated in the clinic, it is likely that the rabbit model may provide an accurate prediction of what could be observed in the clinical setting. The rabbit model may provide an assessment of the therapeutic window (e.g., a dose range that maximizes the immunological response while minimizing reactogenicity) for use in humans for certain flagellin constructs. Vaccine constructs with the minimal TLR5 signaling required for stimulation of an immune response could have real utility in the clinical setting. Such a vaccine would be useful in instances where the subjects have pre-existing immunity to the vaccine antigen, such as with seasonal influenza, or when multiple vaccine antigens need to be combined to form a multivalent vaccine, again as with the case of seasonal influenza.

Example 6

Adsorption of a Flagellin on the Surface of PLGA

The immunogenicity of the compositions, Toll-like Receptor 5 agonists and fusion proteins of the invention, may be improved by association with particles, such as colloidals (e.g., nanoparticles). A Toll-like Receptor 5 agonist, such as flagellin, and an antigen may be attached to the surface of a particle.

Methods:

The biodegradable polymer poly(lactic-co-glycolic acid) (PLGA) was dissolved in acetone at different concentration ranging from 1.25 mg to 10.0 mg/mL. The organic polymer solution was then incubated with flagellin (SEQ ID NO: 447) at different pHs (pH about 4-about 10). The optimal pH of adsorption of the flagellin on PLGA was determined by tracking the amount of flagellin protein in the initial solution and then in the final solution following incubating with the PLGA Results:

The results in Table 9 show that particles could not be recovered at a PLGA concentration of 10 mg/ml. At PLGA concentration of 2.5 or 1.25 mg/ml, PLGA particles were successfully prepared with low polydispersity values. Control of particle size and polydispersity was influences by adjusting the concentration of PLGA in the dispersion. Adsorption of flagellin on the surface of the particles was found to be pH dependent and was maximum when the pH of the medium was different from the pI of flagellin, more specifically when the pH was below the pI of flagellin (pI=5). (Table 9). Optimal adsorption and nanoparticle formation occurred at pH 4.

Conclusions:

Flagellin can be adsorbed on the surface of particles, such as colloidal systems (e.g., nanoparticles). Particles adsorbed with flagellin may be useful in combination with an antigen that is either co-adsorbed on the surface, encapsulated or covalently attached on the surface of the TLR 5 agonist containing particles, which may have superior presentation of the antigen to the immune cells and, thus, generate an enhanced immune response compared to the antigen alone.

TABLE 9

Effect of pH on adsorption of the TLR 5 agonist

| PLGA concentration | Flagellin fljb | Particle size | Flagellin Concentration (% w/w of PLGA) |
|---|---|---|---|
| 10 mg/mL | 4.0 | N/A | N/A |
| 10 mg/mL | 7.0 | N/A | N/A |
| 10 mg/mL | 10.0 | N/A | N/A |
| 2.5 mg/mL | 4.0 | 210 nm | 2.5% |
| 2.5 mg/mL | 7.0 | 150 nm | 2.1% |
| 2.5 mg/mL | 10.0 | 110 nm | 1.7% |
| 1.25 mg/mL | 4.0 | 150 nm | 3.2% |
| 1.25 mg/mL | 7.0 | 115 nm | 3.4% |
| 1.25 mg/mL | 10.0 | 120 nm | 2.2% |

STF2 (*S. typhimurium* fljB)

SEQ ID NO: 447

MAQVINTNSLSLLTQNNLNKSQSALGTAIERLSSGLRINSAKDDAAGQA

IANRFTANIKGLTQASRNANDGISIAQTTEGALNEINNNLQRVRELAVQ

```
-continued
SANSTNSQSDLDSIQAEITQRLNEIDRVSGQTQFNGVKVLAQDNTLTIQ

VGANDGETIDIDLKQINSQTLGLDSLNVQKAYDVKDTAVTTKAYANNGT

TLDVSGLDDAAIKAATGGTNGTASVTGGAVKFDADNNKYFVTIGGFTGA

DAAKNGDYEVNVATDGTVTLAAGATKTTMPAGATTKTEVQELKDTPAVV

SADAKNALIAGGVDATDANGAELVKMSYTDKNGKTIEGGYALKAGDKYY

AADYDEATGAIKAKTTSYTAADGTTKTAANQLGGVDGKTEVVTIDGKTY

NASKAAGHDFKAQPELAEAAAKTTENPLQKIDAALAQVDALRSDLGAVQ

NRFNSAITNLGNTVNNLSEARSRIEDSDYATEVSNMSRAQILQQAGTSV

LAQANQVPQNVLSLLA
```

Example 7

Preclinical Reactogenicity and Immunogenicity Data from Mice and Rabbits Injected with STF2.HA1 (SI)

Introduction

The active component of the VAX125 vaccine includes STF2.HA1 (SI) (SEQ ID NO: 660), which includes the globular head domain of the Solomon Islands HA protein fused to a flagellin (STF2; SEQ ID NO: 661). It is an A/Solomon Islands/3/2006 (H1N1) strain-specific antigen that co-activates the innate and adaptive immune responses by coupling a ligand for a TLR5 (flagellin), which triggers the initial, innate phase of an immune response, to the vaccine antigen (HA), which elicits an antigen-specific adaptive immune response. Toll-like receptors (TLRs) are expressed on various cell types, most notably professional antigen presenting cells (APC), where they act as primary sensors of microbial products and activate signaling pathways that lead to the induction of immune and inflammatory genes.

The STF2.HA1 (SI) fusion protein in F147 buffer (10 mM Tris, 10 mM L-Histidine, 5% trehalose (w/w), 150 mM NaCl, 0.02% polysorbate-80 (w/w), 0.1 mM EDTA, 0.41% (w/w) ethanol at pH 7.0) is a composition referred to herein as "VAX125." In preclinical experiments, mice were immunized subcutaneously with VAX125 that included STF2.HA1-2(SI) in doses ranging from 0.1 μg to 10 μg. Protective hemagglutination inhibition (HAI) and neutralizing antibody titers developed following a prime and boost with as little 0.1 μg of the fusion protein. Rabbits were given intramuscular doses of the fusion protein in a range of 0.5 μg to 300 μg. Most rabbits developed robust IgG responses after a single dose and all developed IgG responses after two doses. Doses as low as 5 μg led to the induction of protective levels of neutralizing antibodies. In both mice and rabbits, antibodies directed towards flagellin (either pre-existing or those elicited by a priming immunization) did not interfere with immune responses to the vaccine on subsequent immunization.

Materials and Methods

TLR5 Bioassay.

TLR5-specific activity of fusion proteins was evaluated by measuring induction of IL-8 production by HEK 293 cells (ATCC, Manassas, Va.). Cells were cultured in 96-well microtiter plates (Costar, ThermoFisher, Hudson, N.H.) at a seeding density of about 3 to about $5\times10^4$ cells in 100 μl/well in DMEM medium supplemented with 10% FCS and antibiotics (Invitrogen, Carlsbad, Calif.). The next day, cells were treated for about 5 hours with serial dilutions of test proteins starting at 5 μg/ml. At the completion of the assay, supernatants were harvested and IL-8 expression was evaluated by ELISA (BD, Franklin Lakes, N.J.). $OD_{450}$ was measured on a microplate spectrophotometer (Molecular Devices-MDS, Sunnyvale, Calif.).

In Vivo Studies: Mouse and Rabbit

BALB/c mice were obtained at 5-6 weeks of age from Charles River Labs (Wilmington, Mass.) and were housed under SPF conditions. After one week acclimation, they were immunized s.c. either at the nape of the neck (volumes of 0.1 mL) or the flank (0.25 mL on each flank for a total of 0.5 mL) with the fusion protein. Mice were typically immunized on study days 0 and 14.

Non-terminal mouse bleeds were performed retro-orbitally and terminal bleeds were performed either retro-orbitally (Princeton) or by cardiac puncture. Blood was collected in BD serum separator tubes (Franklin Lakes, N.J.) and spun 3,000 RPM for 20 minutes to generate serum.

New Zealand White rabbits (NZW) were obtained from Covance or Charles River. Rabbits were between 12 and 17 weeks of age on arrival and were acclimated one week before immunization. Rabbits were immunized i.m. with VAX125 that included varying doses of STF2.HA1-2(SI) as described herein in a total volume of 0.5 mL. Prime and boost injections were administered to alternate thigh muscles.

Bleeding was performed by ear vein at all time points. Food consumption was performed by weighing input and leftover food at 24 hour intervals. Body temperature was taken rectally except for the study in FIG. 33 which was taken by subcutaneous chip.

Mouse Potency: HA-Specific IgG by ELISA

For the ELISA evaluating immunopotency, plates (ThermoFisher, Hudson, N.H.) coated with the HA1-1 (SI) antigen (VaxInnate, Cranbury, N.J.) at 1-3 μg/mL were used to assess the HA-specific activity of mouse serum. Serum samples were diluted in Superblock T20 (ThermoFisher, Hudson, N.H.) and transferred to the coated and blocked plate. Two independent dilutions were performed for each serum sample. After incubation and washing (1×PBS, 0.05% Tween 20, Mallinkrodt-Baker, Phillipsburg, N.J.), the plates were developed using a goat anti-mouse IgG (Jackson Immunoresearch, West Grove, Pa.) directly conjugated with horse radish peroxidase followed by $TMB/H_2SO_4$, (ThermoFisher, Hudson, N.H. and Mallinkrodt-Baker, Phillipsburg, N.J.). Plates were read at 450 nm (SpectraMax 190, Molecular Devices, Sunnyvale, Calif.). A dilution series of purified mouse IgG (AbD Serotech, Oxford, UK) was coated onto part of each plate to generate a standard curve, which was fit using a 4-parameter logistic equation (Softmax Pro 5.2, Molecular Devices). This curve allows calculation of HA-specific IgG in μg/mL.

Mouse Potency: Microneutralization

In the microneutralization assay, the serum samples were treated with receptor destroy enzyme (RDE, 1 part serum plus 3 parts RDE, DENKA SEIKEN, purchased through Accurate Chemicals, Westbury, N.Y.) at 37° C. over night, heat inactivated (56° C., 30 min), co-cultured with 100 TCID50 of influenza A/Solomon Islands/3/2006 (CDC, Atlanta, Ga.) for 1 hr in 96-well microtiter plates. MDCK cells ($4\times10^4$/well) in DMEM medium (DMEM supplemented with 1% BSA, 20 mM HEPES, and 100 IU/ml Penicillin and 100 μg/mL Streptomycin, Invitrogen, Carlsbad, Calif.) were then added. Following overnight incubation (37° C. for 20 hr), the medium was aspirated. The cells were then washed once with PBS (Invitrogen), fixed in 80% acetone (Mallinkrodt-Baker, Phillipsburg, N.J.), air-dried, and subjected to ELISA assay with anti-NP monoclonal antibody (BEI Resources, Manassas, Va.) as the detection antibody (1:2000) and goat anti-mouse Fcγ specific IgG:HRP (1:5,000, Jackson ImmunoResearch, West Grove, Pa.) as the secondary antibody. Virus titration controls were also included to ensure that the appropriate virus dose was used.

Mouse Potency: Hemagglutinin Inhibition Assay (HAI)

In the HAI assay, the serum samples were treated with RDE (DENKA SEIKEN, purchased through Accurate Chemicals, Westbury, N.Y.) for 18-20 hr at 37° C. and heat inactivated (56° C., 30 min). Twenty five microliters of the treated serum samples were added to V-bottom 96-well plate (ThermoFisher, Hudson, N.H.) in duplicate, and serially (two-fold) diluted. Influenza A/Solomon Islands/03/2006 virus (4 HAU in 25 µl) was added to the serum samples and incubated at room temperature for 30 min. Fifty microliters of 0.5% Chicken red blood cells (CRBC, Rockland Immunochemicals, Gilbertsville, Pa.) were added to the virus serum mixture. Reference positive serum (ferret anti-A/Solomon Islands/03/2006, CDC, Atlanta, Ga.) and a CRBC control are also included. Following ~2-hour incubation at room temperature, the hemagglutination patterns of the samples were read. The HAI titers were defined as the reciprocal dilutions that cause complete inhibition of virus-specific hemagglutination.

C Reactive Protein ELISA

Determination of CRP levels from rabbit serum was performed using a commercial sandwich ELISA kit (Immunology Consultants Lab, Inc., Newberg, Oreg.). Kits were run according to manufacturer's instructions and with provided reagents. The kit includes a standard curve which was fit using a 4-parameter logistic equation (Softmax Pro 5.2, Molecular Devices, Sunnyvale, Calif.). Serum samples were run at 1:1,000 or 1:5,000 dilution. Only OD values in the range of the standard curve were used.

Rabbit Potency: HA- and STF2-Specific IgG by ELISA

For the ELISAs evaluating HA- and STF2-specific IgG, plates (ThermoFisher, Hudson, N.H.) coated with either the HA1-1 (SI) protein at 3 µg/mL or STF2 at 1 µg/mL were used to assess the specific activity of rabbit serum. In brief, serum samples were diluted in Superblock T20 (ThermoFisher, Hudson, N.H.), and transferred to the coated and blocked plate. Two independent dilutions were performed for each serum sample. After incubation and washing (1×PBS, 0.05% Tween 20, Mallinkrodt-Baker, Phillipsburg, N.J.), the plates were developed using a goat anti-rabbit IgG (Jackson ImmunoResearch, West Grove, Pa.) directly conjugated with horse radish peroxidase followed by TMB/$H_2SO_4$, (ThermoFisher, Hudson, N.H. and Mallinkrodt-Baker, Phillipsburg, N.J.). Plates were read at 450 nm (SpectraMax 190, Molecular Devices, Sunnyvale, Calif.). A dilution series of purified rabbit IgG (Bethyl Laboratories, Montgomery, Tex.) was coated onto part of each plate to generate a standard curve, which was fit using a 4-parameter logistic equation (Softmax Pro 5.2, Molecular Devices). This curve allows calculation of HA- and STF2-specific IgG in µg/mL.

Rabbit Potency: Microneutralization

The microneutralization assay measures the levels of virus-specific neutralizing antibodies (Ab) in serum samples by quantifying reduction in influenza NP protein in virus-infected MDCK cells as a result of virus-antibody coincubation. To remove the nonspecific inhibitors, serum samples were treated with RDE II (1 part of serum+3 parts of RDE II, DENKA SEIKEN, purchased through Accurate Chemicals, Westbury, N.Y.) at 37° for 18-20 hr and 56° C. for 30 min. Next, the treated sera were serially diluted in duplicate in 96-well tissue culture plates, and coincubated with 100 TCID50 of influenza A/Solomon Islands/03/2006 (CDC, Atlanta, Ga.) for 1-1.5 hr at 37° C. This was followed by addition of $4 \times 10^4$/well of MDCK cells/well (ATCC, Manassas, Va.). After 18-22 hr incubation, quantification of NP protein is performed using a standard ELISA protocol using anti-NP MAb (BEI, NR-4282, 1:2,000) as the primary antibody and Goat anti-mouse IgG the secondary antibody (JacksonImmunoResearch, West Grove, Pa., 1:5,000). Sheep anti-A/Solomon Islands/03/2006 serum (NIBSC, Herfordshire, UK) was included as a reference serum in each plate to monitor the variability. Plate washing, substrate TMB and stop solution, and OD450 reading were described above. Neutralizing antibody titers are defined as the reciprocal dilutions that are below the specific signal calculated from the OD values of negative and positive controls.

Results

IL-8 Secretion

Bioactivity of different protein lots are reported as a ratio of the IL-8 produced in response to a selected concentration of the test article (about 278 ng/ml) relative to that for the same concentration of the reference standard. A ratio of less than 1.00 indicates reduced bioactivity compared to the reference. Table 10 shows that two different lots of STF2.HA1-2(SI) elicited similar amounts of IL-8 from HEK-293 cells.

TABLE 10

STF2.HA1 (SI) Stimulates IL-8 Secretion through TLR5

| Reference | Well # | Mean Result (ng/nL) | Mean of all wells | T/C ratio |
| --- | --- | --- | --- | --- |
| STF2.HA1-2(SI) lot 1 (2.19 mg/mL) | 1 | 635.470 | 1105.669 | N/A |
| | 2 | 797.188 | | |
| | 3 | 1073.319 | | |
| | 4 | 1227.599 | | |
| | 5 | 1362.383 | | |
| | 6 | 1538.054 | | |
| STF2.HA1-2(SI) lot 2 (4.0 mg/mL) | 1 | 1464.454 | 1407.564 | 1.3 |
| | 2 | 1594.904 | | |
| | 3 | 1608.427 | | |
| | 4 | 1304.132 | | |
| | 5 | 1379.742 | | |
| | 6 | 1093.725 | | |

Mouse and Rabbit Immunopotency

Figure 26:
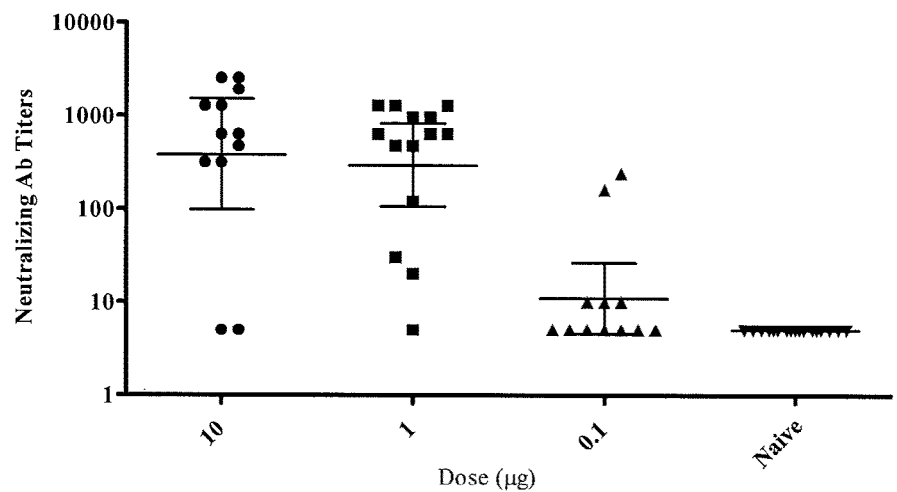
FIG. 26 depicts neutralizing antibody titers of sera from mice immunized with STF2.HA1 SI. Results show the geometric mean±95% CI (Bars) of 15 individual sera per group as well as results of individual mice.

In one experiment, groups of 15 BALB/c mice were immunized s.c. twice with doses of 10 µg, 1 µg and 0.1 µg of STF2.HA1 (SI) at a 2-week interval. Serum samples were prepared 7 days post the boost, as described in Methods. Neutralizing antibody titers were defined as the reciprocal dilutions that are below the specific signal calculated from the OD values of negative and positive controls. The micro-neutralization results are shown in FIG. 26. The results indicated that two immunizations of mice with STF2.HA1 at 1 µg and 10 µg doses elicit significant levels of neutralizing antibodies to A/Solomon Islands/03/2006 (p<0.05, in ANOVA/Tukey test).

Figure 27:
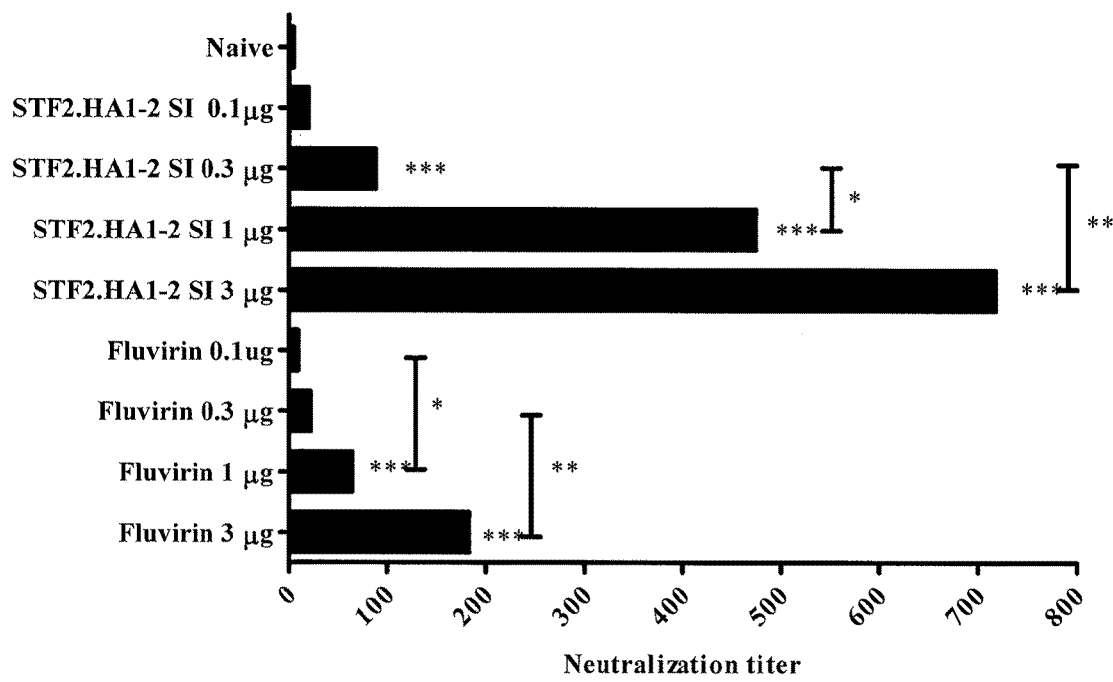
FIG. 27 depicts neutralizing antibody titers of post-boost sera from mice immunized with STF2.HA1 SI. Sera were harvested and evaluated for neutralizing titers using the micro-neutralization assay. Results show the geometric mean of 15 individual sera per group. An asterisk over the bar indicates significant responses as compared to the naïve group using ANOVA/Tukey test. Groups connected by brackets were also compared by ANOVA/Tukey test and found to statistically differ. Asterisks indicate the level of significance with *=p<0.05; =p<0.01; and *=p<0.001 in the ANOVA.

In a second comparative immunogenicity study, groups of 15 BALB/c mice were immunized s.c. twice with 3 µg, 1 µg, 0.3 µg or 0.1 µg of STF2.HA1 (SI) or Fluvirin® (Novartis) at a 2-week interval. Serum samples were harvested 7 days post the boost, and prepared as described above for the microneutralization assay. The results, shown in FIG. 27, indicate that both STF2.HA1 (SI) and Fluvirin® elicit virus-specific neutralizing antibodies in a dose-dependent manner. Immunization with STF2.HA1 (SI) at as low as 0.3 µg dose resulted in a significant increase in virus specific neutralizing antibodies. The neutralizing antibody titers induced in mice by 3 µg or 1 µg of Fluvirin® compared to 1 µg or 0.3 µg of STF2.HA1 (SI) are similar as determined by ANOVA/Tukey test.

Figure 28A:
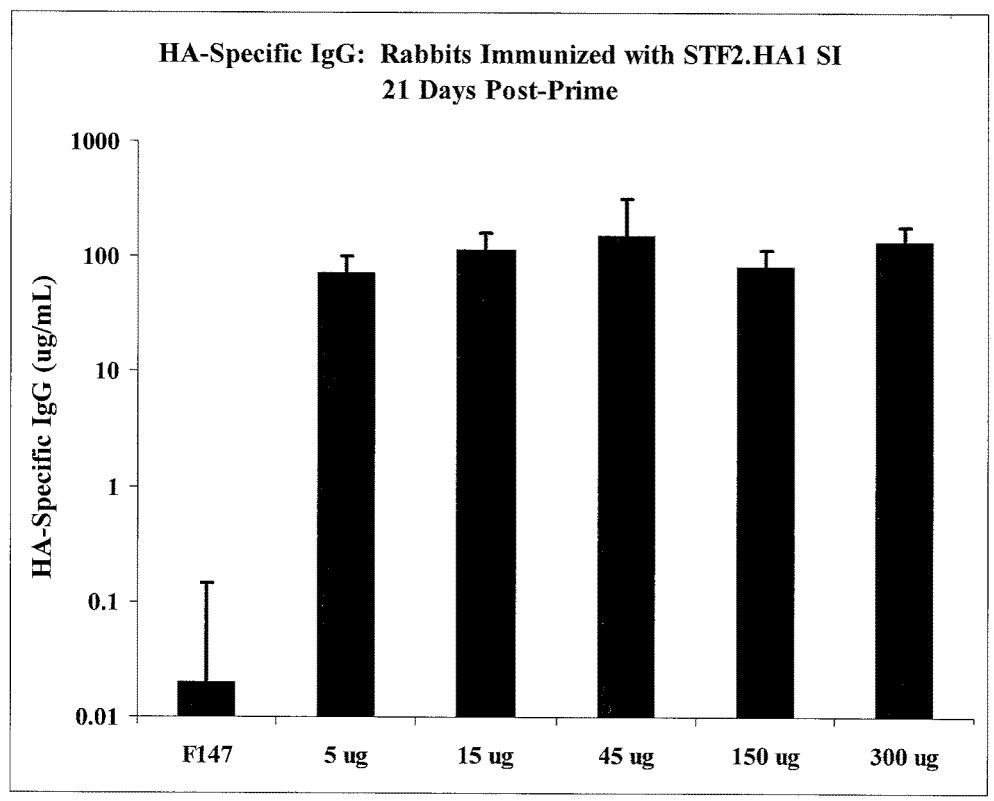
FIGS. 28A and 28B depict SI HA-specific IgG Response to STF2.HA1 SI in rabbits. Six rabbits per group were given two immunizations with STF2.HA1 SI at indicated doses on days 0 and 21. Serum was collected on day −1 (prebleed), day 21 (post-prime, top panel) and day 28 (7 days post-boost, bottom panel). Sera were bound to plates coated with HA1-1 (SI) (baculovirus, 1 µg/mL), at dilutions ranging from 1:25 to 1:39,0625. OD values of HA-specific IgG were converted to µg/ml using a standard curve of polyclonal IgG fit with a 4-parameter logistic curve (Softmax Pro 5.2, Molecular Devices). Prebleed values are subtracted from each group. Data shown are means+/−standard deviations of 6 rabbits per group.
Figure 28B:
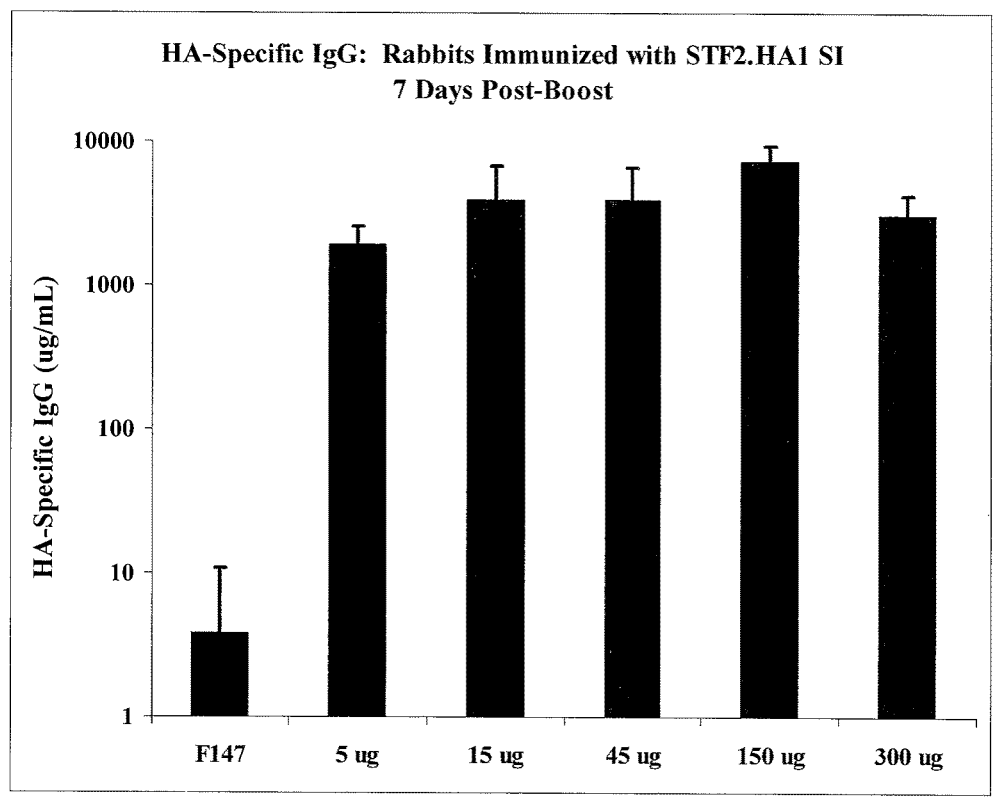
Figure 29:
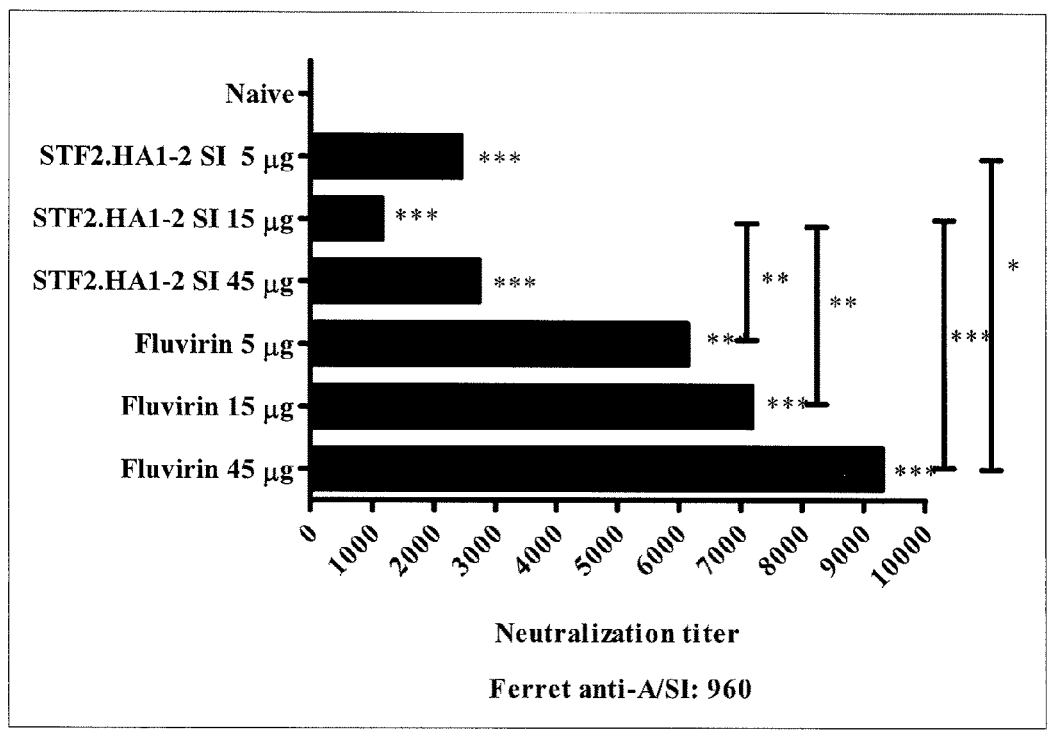
FIG. 29 depicts neutralizing Ab titers of post-boost sera from rabbits immunized with STF2.HA1 SI (also known as STF2.HA1-2 (SI)) or Fluvirin®. Six rabbits per group were given two immunizations i.m. with STF2.HA1 SI or Fluvirin® at indicated doses on days 0 and 21. Sera were harvested 7 days post the booster dose and evaluated for neutralizing titers using the micro-neutralization assay. Results show the geometric mean of 6 individual sera per group. An asterisk over the bar indicates significant responses as compared to the naïve group using ANOVA/Tukey test. Groups connected by brackets were also compared by the same test and found to statistically differ. Asterisks indicate the level of significance with *=p<0.05; =p<0.01; and *=p<0.001 in the ANOVA/Tukey test. Ferret reference anti-sera obtained from the CDC was included as a positive control and the titer is given at the bottom of the graph.
Figure 30:
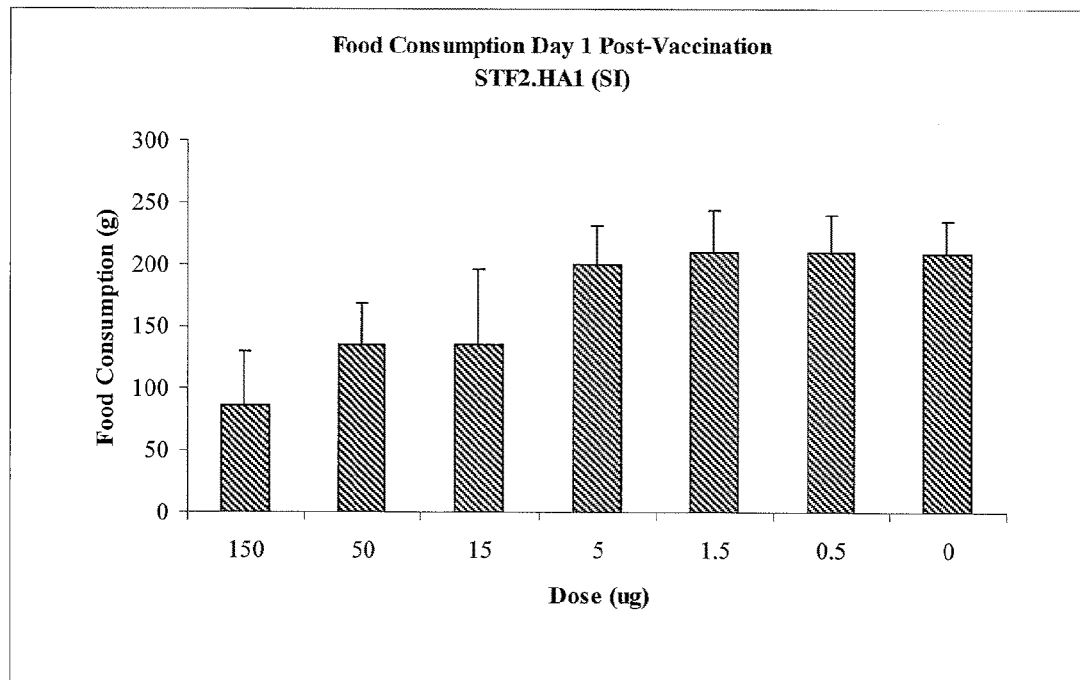
FIG. 30 depicts the effect of STF2.HA1 SI on food consumption in rabbits. Groups of 6 rabbits were injected i.m. with the indicated dose of STF2.HA1 SI (also known as STF2.HA1-2 (SI)) on day 0. Food consumption was monitored from day 0 to day 1. Data is presented as the group mean food consumption±SD.

A dose ranging study of the product STF2.HA1 (SI) in rabbits was also performed. Rabbits received 300 µg, 150 µg, 45 µg, 15 µg and 5 µg delivered i.m. on days 0 and 21. Dose-related lacrimation was observed in the rabbits about 24 hours post the priming immunization. This self-resolved by 48-72 hours. Interestingly, the frequency of this observation was highest at 150 µg (6 of 6 animals) and substantially lower at 300 µg (1 of 6 animals). As shown in the FIG. 28A, significant HA-specific IgG is observed 21 days post the priming immunization at all dose levels. This response was boosted in all groups as shown in FIG. 28B.

Micro-neutralization assays were performed on the rabbit serum using the method described above for mouse serum. A single boost with STF2.HA1 (SI) led to robust increases in antibody titers compared to those in normal sera (4-64 fold, Table 11). Although the levels of neutralizing antibodies in the serum samples from 45 µg and 150 μg dose groups appear to be higher than those in the lower dose groups, there was no statistical difference among different dose groups according to ANOVA/Tukey test. Thus, STF2.HA1 (SI) is highly immunogenic in rabbits with doses as low as 5 μg leading to the induction of protective levels of neutralizing antibodies.

TABLE 11

Neutralization of influenza A/Solomon Islands/3/2006 by rabbit anti-STF2.HA (SI)

| Groups | Dose (μg/animal) | Animals per group (n) | GMT[a] | 95% CI[b] | Significance[c] |
|---|---|---|---|---|---|
| F147 | | 6 | 10 | 10-10 | |
| SID.008 | 5 | 6 | 411 | 302-560 | *** |
| SID.008 | 15 | 6 | 544 | 314-940 | *** |
| SID.008 | 50 | 6 | 565 | 179-1786 | *** |
| SID.008 | 150 | 6 | 685 | 274-1713 | *** |

[a]geometric mean titers;
[b]95% confidence intervals;
[c]significant in ANOVA/Tukey Test (vs F147),
***, $p < 0.001$.

In an extension of the comparative immunogenicity experiments described above for mice, groups of 6 New Zealand White rabbits were immunized i.m. twice with 45, 15 or 5 μg of STF2.HA1 (SI) or Fluvirin® at a 3-week interval. Serum samples were prepared 7 days post the boost, as described above for the micro-neutralization assay. The results, shown in FIG. 29, indicate that low doses of both vaccines elicit robust neutralizing titers in the rabbit. Certain inter-group comparisons by ANOVA (45 μg Fluvirin® compared to 15 μg STF2.HA1 (SI)) indicate that STF2.HA1 (SI) is less potent than Fluvirin®, while other inter-group comparisons (15 μg Fluvirin® compared to 5 μg of STF2.HA1 (SI) by ANOVA/Tukey test show no statistical significant difference between Fluvirin® and STF2.HA1 (SI).

VAX125 NonClinical Results

In the studies of varying doses of VAX125 in rabbits, described above, dose-related lacrimation 24 hours post the prime immunization was observed. Systemic reactogenicity of VAX125 was evaluated in rabbits to include dose-related measures of temperature, food consumption and CRP.

Groups of rabbits were immunized with doses of STF2.HA1 (SI) in VAX125 ranging from 150 μg to 0.5 μg. Food consumption and CRP levels were evaluated post the prime immunization. The entire dose range for STF2.HA1 (SI) was evaluated in a single experiment. The data are depicted in FIGS. 30-32. Administration of STF2.HA1 (SI) suppresses appetite in rabbits in a dose-dependent manner. Food consumption for the 50 and 15 μg dose groups approaches baseline. CRP increased in a dose-dependent fashion after administration of STF2.HA1 (SI) (FIG. 31). Consistent with these observations, temperature was elevated at 2 hours post-vaccination with STF2.HA1 (SI) at doses of 50 μg and 150 μg (FIG. 32).

The kinetics of temperature elevation after injection with STF2.HA1 (SI) was also determined. The results of this study indicate that temperature rises for at least 10 hours after immunization while it is back to normal by 24 hours (FIG. 33). A dose ranging study of STF2.HA1 (SI) measuring temperature at 6 hours post-immunization was therefore performed. Doses from 15 to 0.5 μg were compared with F147 buffer alone. Consistent with the results at 2 hours, temperature elevation was dose-dependent (FIG. 34) and began to rise significantly at doses ≥15 μg.

Serum from the rabbit study was evaluated in the microneutralization assay. As shown in FIG. 35, doses of STF2.HA1 (SI) as low as 1.5 μg generate substantial neutralizing antibody titers, with seroconversion rates ranging from 67 to 100%. A dose of 0.5 μg also elicits neutralizing antibodies in 33% of the rabbits.

Conclusion

A molecule linking of *Salmonella typhimurium* flagellin and a globular head of influenza A HA was produced in *E. coli* and when given to rabbits and mice, resulted in virus-neutralizing antibodies. The innate immune stimulus function of the STF2 was clearly retained as indicated by IL-8 secretion from HEK-293 cells, and by decreases in food consumption, and increases in body temperature and serum CRP observed at higher doses of the vaccine. At lower doses, however, reactogenicity measures in the rabbit were similar to buffer control while significant neutralizing antibody titers, as well as HA-specific IgG, were detected.

These titers are similar in magnitude to those elicited by Fluvirin®, a vaccine used in humans. In mice, 1 μg of STF2.HA1 (SI) produces higher neutralizing antibody titers than 3 μg of Fluvirin®, which has roughly the same amount of SI HA protein. Thus, compositions that include antigens in combination with Toll-like Receptor 5 agonists, such as STF2.HA1-2 (SI), may have a significant advantage over traditional influenza vaccines, because such compositions can be made in *E. coli*, which has a higher protein yield per square foot of manufacturing capacity relative to fertilized egg-based manufacturing. In addition, the potent immunogenic response and low reactogenicity at low doses compared to currently used vaccines, was unexpected.

Example 8

Escalating Dose-Ranging Study to Evaluate the Safety and Immunogenicity of the VAX125 in Humans In order to assess the safety and efficacy of the STF2.HA1-2 (SI) fusion protein (SEQ ID NO: 660; also referred to herein as "STF2.HA1 (SI)") in F147 (10 mM Tris, 10 mM L-Histidine, 5% trehalose (w/w), 150 mM NaCl, 0.02% polysorbate-80 (w/w), 0.1 mM EDTA, 0.41% (w/w) ethanol at pH 7.0), Phase I clinical trials were performed. The STF2.HA1-2 (SI) fusion protein in combination with the F147 buffer is referred to as "VAX125." The safety and efficacy of the VAX125 composition was assessed. The VAX125 compositions were administered i.m., in a single dose regimen in healthy adults 18-49 years of age. Symptom diary cards were completed and physical assessments were performed on all subjects. In addition, serum cytokine levels and C-reactive protein (CRP) were quantified before and after administration of the composition.

The immunogenicity of the VAX125 composition in human subjects was evaluated. The primary endpoint was the serum hemagglutination inhibition (HAI) antibody against egg-grown A/Solomon Islands/06 was evaluated on days 0, 14 and 28. (Belshe, R. B., et. al., *The J. of Infectious Diseases* 181:1133-1137 (2000)). In addition, serum was assessed in a microneutralization assay using egg grown Solomon Islands virus, and in an ELISA using recombinant HA as previously described (Katz, J. M. et. al., *The J. of Infectious Diseases* 180:1763-1770 (1999)).

Materials and Methods

Study Design

VAX125-01 Phase 1, Part 1: This study was a dose escalation, prospective, open-label study design in healthy, not previously vaccinated subjects. The study consisted of 7 groups ranging from 0.1 to 8 µg VAX125 (total protein): 0.1 µg, 0.3 µg, 1 µg, 2 µg, 3 µg, 5 µg or 8 µg. There were 8 subjects per group, 56 subjects total. Immunogenicity was assessed at day 0, 7, 14 and 28. Day 0 is the day the composition was administered.

VAX125-01 Phase 1, Part 2: This study was a randomized, placebo-controlled, blinded study in healthy adults. The purpose of this study was to develop additional safety and immunogenicity data at well tolerated doses that could serve as the basis for a trivalent formulation at 1 µg or 2 µg.

Study Participants:

Prior to participating in study procedures, each volunteer provided voluntary, written informed consent. Subjects were 18-49 years of age and healthy as ascertained by medical history, screening physical examination and screening laboratory analysis. The main exclusion criteria included history of active medical condition or presence of abnormal screening laboratory results, impaired immune response for any reason, documented influenza infection within the previous 6 months, recent receipt of non-study vaccine, or allergy to the vaccine components.

Procedures

In the first study, participants were randomly assigned to receive 1 administration of escalating doses of VAX125 to increase the concentration of the STF2.HA1-2 (SI) fusion protein: either 0.1 µg, 0.3 µg, 1 µg, 2 µg, 3 µg, 5 or 8 µg. Study participants received the vaccine by intramuscular (i.m.) injection in the deltoid muscle of the non-dominant arm. Participants maintained a memory aide following the dose of VAX125 and for 6 days thereafter, on which they recorded solicited local and systemic reactions graded as none, mild, moderate, or severe. Adverse reactions were assessed by study participants using a 4 point scale (0-3). Solicited local reactions were redness, swelling or induration, pain and ecchymosis. Solicited systemic reactions were fever, headache, joint pain, fatigue, muscle aches, shivering (chills) and increased sweating.

Subjects returned to the clinic for safety observations on Days 1 and 7 after administration of VAX125 for a brief physical examination, memory aide review and laboratory assessment. Additional safety laboratory assessments were performed on Days 14, and 28. Laboratory analysis included CBC, BUN, Creatinine, urinalysis and liver function tests. C reactive protein (CRP, Latex Enhanced Immunoturbidimetric, Bayer, Pittsburgh, Pa.) assays were performed on Day 0 (preadministration of the VAX125), and 1. HAI, microneutralization and IgG responses to HA and flagellin assays were performed on sera collected on days 0, 7, 14, and 28 following administration of VAX125.

Dose Escalation Procedures (Study 1)

Within each dose group, upon completion of the Day 1 clinical visit, Day 3 phone call and safety labs at Day 1 data were reviewed by the safety monitoring committee.

Upon completion of the dose escalation portion of the initial study, the protocol allowed for the enrollment of 48 additional subjects randomly assigned to receive one of two dose levels determined to have optimal safety and immunogenicity, or placebo.

STF2.HA1-2 (SI) Fusion Protein

The STF2.HA1-2 (SI) fusion protein was purified under GMP conditions using standard methods of chromatography (WCBF, Madison, Wis.). The fusion protein was formulated in buffer F147, vialed and administered to humans.

Clinical Assays

Hemagglutination Inhibition (HAI) Assay

The clinical HAI assay was performed using turkey red blood cells (RBC, CBT Farms, Federalsburg, Md.) and 96 well V-bottom microtiter plates (VWR, West Chester. Pa.). RBC were washed three times in PBS (Invitrogen, Carlsbad, Calif.). Cells were resuspended to a final concentration of 0.75% RBC in PBS. Subject serum was treated with receptor destroying enzyme (RDE, Denka Sieken, Accurate Chemical, Westbury, N.Y.) to remove non-specific inhibitors (1:4 dilution). Influenza A/Solomon Islands/3/2006 was prepared at 4 HAU/25 μl L in PBS. Serum was serially diluted 1:2 leaving 25 μl L in each row. Virus was then added in a volume of 25 μL, the plate was mixed gently and incubated for 1 hour at room temperature. Fifty microliters of 0.75% RBC was then added to each well, plates were mixed gently and allowed to settle at 4° C. until cells form a well-defined pellet.

Control wells included that contained RBC only (no virus or serum); RBC+ virus (no serum) and RBC, virus and control serum (pooled human serum). The serum HAI titer was determined as the highest dilution in which a well defined pellet or "button" formed.

Microneutralization

A microneutralization assay was performed with the use of protocol modified from that developed by (Katz, J. M., et. al., *The J. of Infectious Diseases* 180:1763-1770 (1999)). Serum samples were serially diluted in duplicate, starting at 1:20, co-cultivated with 100 tissue culture cell infectious doses (TCID) that cause 50% lysis ($TCID_{50}$) of influenza A/Solomon Islands/3/2006 for 1.5 hr in 96-well microtiter plates. MDCK cells (ATCC, Manassas, Va., $4\times10^4$/well) in DMEM medium (DMEM supplemented with 1% BSA, 20 mM HEPES, and 100 IU/mL Penicillin and 100 μg/mL Streptomicin (Invitrogen, Carlsbad, Calif.)) were then added. Following a 20-hr incubation at 37° C., the medium was aspirated. The cells were then washed once with PBS (Invitrogen, Carlsbad, Calif.), fixed in 80% acetone (Sigma, St. Louis, Mo.), air-dried, and subjected to ELISA assay with monoclonal anti-influenza A nucleoprotein (1:2000, clones A1 and A3, ATCC/BEI resources, Manassas, Va.) as the detection antibody and goat anti-mouse Fcgamma specific IgG:HRP (1:5000, Jackson ImmunoResearch Laboratories, Inc., West Grove, Pa.) as the secondary antibody.

Following development in 1-step Ultra TMB-ELISA substrate (Thermo, Hudson, N.H.) and termination of the reaction in 1 M $H_2SO_4$, (Mallinckrodt Baker, Phiilipsburg, N.J.) the $OD_{450}$ was read (Spectramax 190, Molecular Devices, Sunnyvale, Calif.). Virus back titration, positive serum control, virus controls (VC), and cell controls (CC) were included. The end point of virus neutralizing antibody for each serum was determined using the equation: 50% of specific signal=[(Average OD of VC wells)−(Average OD of CC wells)]/2+Average OD of CC wells. Values below this value are considered positive for neutralizing activity.

ELISA

Immulon 4HBX plates (Thermoelectron Corp., Milford, Mass.) were coated with HA1-1 (SI) (SEQ ID NO: 662) (recombinant protein amino acids 53-324 from Solomon Islands virus HA; SEQ ID NO: 665 made in insect cells), or recombinant STF2.his6 (made in E. coli), at 1 µg/mL for 15.5 to 17.5 hours at 4° C. Purified human IgG (AbD Serotec, Raleigh, N.C.) was diluted 8 times using 1×PBS (EMD, Gibbstown N.J., 4-fold each time) beginning at a concentration of 0.9 µg/mL and also coated overnight.

Plates were washed the next day and blocked with 300 µl of Superblock with T20 (Thermo, Hudson, N.H.) for 2 hours at 23-27 C. Dilutions of sera were prepared beginning at a 1:500 fold dilution and ending at a 1:15807 fold dilution (3.162 fold dilutions each time) in triplicates using Superblock. Positive and negative control serum were diluted 2500 times using Superblock. Blocked plates were washed 3× with 1×PBS/0.05% Tween (J. T. Baker, Phillipsburg, N.J.) and the diluted sera and controls were added to the HA1-1 coated wells. Superblock alone was added to wells coated with human IgG. Following 2 hour incubation at 23-27 C, plates were washed again and incubated with 100 µl of a 1:5000 dilution of HRP-conjugated anti-human IgG antibodies (Jackson Immuno Research labs Inc., West Grove, Pa.) for 40 to 45 minutes.

Plates were washed three times and 100 µl of pre-warmed TMB substrate (Thermo, Hudson, N.H.) was added to the wells. Color development was allowed for 4 minutes after which 100 µl of 1 M $H_2SO_4$ (Mallinckrodt Baker, Phillipsburg, N.J.) was added to stop the reaction. The OD at 450 nm was read within 40 minutes of stopping the reaction (Spectramax 190, Molecular Devices, Sunnyvale, Calif.). The concentration of anti-HA IgG antibodies are determined using a 4 parameter logistic curve (SoftMax Pro 5.2, Molecular Devices, Sunnyvale Calif.) generated from the human IgG standards and their resulting O.Ds. Sera that were highly concentrated and out of range of the standard curve were repeated in an alternate ELISA using dilutions ranging from 31, 250 to 3,906,250.

Results

Table 12 provides the demographic characteristics of the subjects who participated in the Part 1 of the study. The groups are well balanced in terms of age, sex, and race-ethnicity.

TABLE 12

Demographic characteristics

| Group | Dose | No. of subjects | Mean age | Age range | Male | Female |
|---|---|---|---|---|---|---|
| 1 | 0.1 | 8 | 34.5 | 23-45 | 2 | 6 |
| 2 | 0.3 | 8 | 33 | 22-46 | 3 | 5 |
| 3 | 1 | 8 | 30 | 19-46 | 4 | 4 |
| 4 | 2 | 8 | 37.4 | 22-49 | 3 | 5 |
| 5 | 3 | 8 | 37 | 25-43 | 3 | 5 |
| 6 | 5 | 8 | 32.4 | 19-45 | 4 | 4 |
| 7 | 8 | 8 | 37.6 | 25-48 | 1 | 7 |

Table 13 describes the safety profile for each dose group of Part 1. Symptoms are divided into local symptoms which are symptoms at the site of injection such as pain, redness or swelling and systemic symptoms such as headache, fatigue, joint pain, muscle aches, chills and sweats. The fusion protein was well tolerated by nearly all subjects. Subjects in the 5 µg and 8 µg group had an increase in moderate arm pain. There were two subjects who had severe systemic symptoms, one in the 2 µg group, which appeared unrelated to VAX125 and one in the 3 µg group which began 2 hours after VAX125 administration and lasted about 2-3 hours.

TABLE 13

Local and systemic reactogenicity reported after VAX125 administration

| Dose (µg) | No. of subjects | No. subjects with arm pain | | | No. subjects with systemic symptoms | | | |
|---|---|---|---|---|---|---|---|---|
| | | None | Mild | Mod | None | Mild | Mod | Severe |
| 0.1 | 8 | 6 | 2 | 0 | 8 | 0 | 0 | 0 |
| 0.3 | 8 | 5 | 3 | 0 | 7 | 1 | 0 | 0 |
| 1 | 8 | 4 | 3 | 1 | 8 | 0 | 0 | 0 |
| 2 | 8 | 2 | 5 | 1 | 6 | 1 | 0 | 1a |
| 3 | 8 | 5 | 3 | 0 | 7 | 0 | 0 | 1b |
| 5 | 8 | 1 | 2 | 5 | 7 | 1 | 0 | 0 |
| 8 | 8 | 1 | 2 | 5 | 6 | 2 | 0 | 0 | a. Severe fatigue reported on day 7 not related to administration of VAX125
b. Severe systemic syndrome onset 2 hrs after administration of VAX125 with fever (101.5° F.), severe chills, myalgias, malaise, mild nausea without vomiting. Symptoms lasted about 2-3 hours.

A summary of the HAI geometric mean titers by dose and fold-rise in Part 1 of the study is shown in Table 14. Significant HAI titers were observed on day 0, most likely reflecting a recruiting population, many of whom may have been vaccinated against influenza in recent years. All VAX125 participants showed a rise in hemagglutination inhibition geometric mean titer (HAI GMT) on days 14 and 28, although the fold rise was less than 4 for the 0.1 µg and 0.3 µg dose levels.

TABLE 14

Geometric mean titers and mean fold increase for each dose group

| Dose (µg) | HAI GMT | | | Fold-rise | |
|---|---|---|---|---|---|
| | Day 0 | Day 14 | Day 28 | D14/d0 | D28/d0 |
| 0.1 | 87 | 123 | 174 | 1.4 | 2.0 |
| 0.3 | 113 | 293 | 381 | 2.6 | 3.4 |
| 1 | 160 | 698 | 905 | 4.4 | 5.7 |
| 2 | 95 | 587 | 587 | 6.2 | 6.2 |
| 3 | 174 | 987 | 640 | 5.7 | 3.7 |
| 5 | 62 | 1,522 | 1,174 | 24.7 | 19.0 |
| 8 | 40 | 320 | 349 | 8.0 | 8.7 |

In Table 15, the 7 dose groups of Part 1 were combined into 3 representing a low, mid and high dose groups. The C-reactive protein (CRP) is measured 1 day after administration of the fusion protein and is indicative of cytokine (IL-6) response. Because of the variation in the preadministration of VAX125 HAI titers the fold increase may be more useful as a measure of immune response. Seroconversion was defined as a four-fold increase in titer and seroprotection is defined as a minimum post-administration titer of 40. Using this method of analysis, the low dose groups have a low CRP rise and a low rise in seroconversion. Due to the pre-administration HAI titers, however, there was 100% seroprotection. In both the mid and high doses, CRP levels rise as well as the HAI GMTs. In the mid-level group, seroconversion rose to 50%, and in the high dose group the seroconversion rate was 75%. Seroprotection rates were 100 and 94% in the mid and high dose groups, respectively.

TABLE 15

HAI GMT titers and fold rise and seroconversion (SC)
and seroprotection rates after VAX125 administration

|  | Low dose (0.1-0.3 µg) n = 16 | Mid dose (1-3 µg) n = 24 | High dose (5-8 µg) n = 16 |
| --- | --- | --- | --- |
| C-reactive protein | 1.8 | 5.2 | 10.2 |
| HAI-pre GMT | 99 | 138 | 50 |
| HAI-post GMT | 258 | 698 | 640 |
| HAI fold increase | 2.6 | 5 | 13 |
| Seroconversion (n, %) | 4 (31%) | 12 (50%) | 12 (75%) |
| Seroprotection (n, %) | 16 (100%) | 24 (100%) | 15 (94%) |

The results from Part 2 of the study are summarized in Table 16. In this case, seroresponse is defined as at least a 4-fold rise with a minimum post-administration of the fusion protein titer of 40. As expected, no rise in HAI titers was seen in the placebo group while the 1 and 2 µg groups had appreciable increases in both seroresponse (50 and 81% respectively) and seroprotection (75 and 100%, respectively).

TABLE 16

VAX125-01: Phase I, Part 2
GMT, seroresponse (SR) and seroprotection (SP) rates

|  | Time point | Control n = 16 | 1 µg n = 16 | 2 µg n = 16 |
| --- | --- | --- | --- | --- |
| GMT | Day 0 | 91 | 108 | 62 |
|  | Day14 | 87 | 494 | 795 |
|  | Day 28 | 84 | 473 | 761 |
| GMT | day 14 | 1 | 4.6 | 12.9 |
| MFR | day 28 | 1 | 4.4 | 12.3 |
| SR* (%) |  | 0 | 8 (50) | 13 (81) |
| SP** (%) |  | 0 of 2 | 3 of 4 (75) | 5 of 5 (100) |

*Seroresponse: increase in HAI antibody titer of at least fourfold with a min. post-administration titer of 40
**Seroprotection: acheivement of a minimum post-administration HAI titer of 40 among subjects with pre-administration titers of <40

Figure 36:
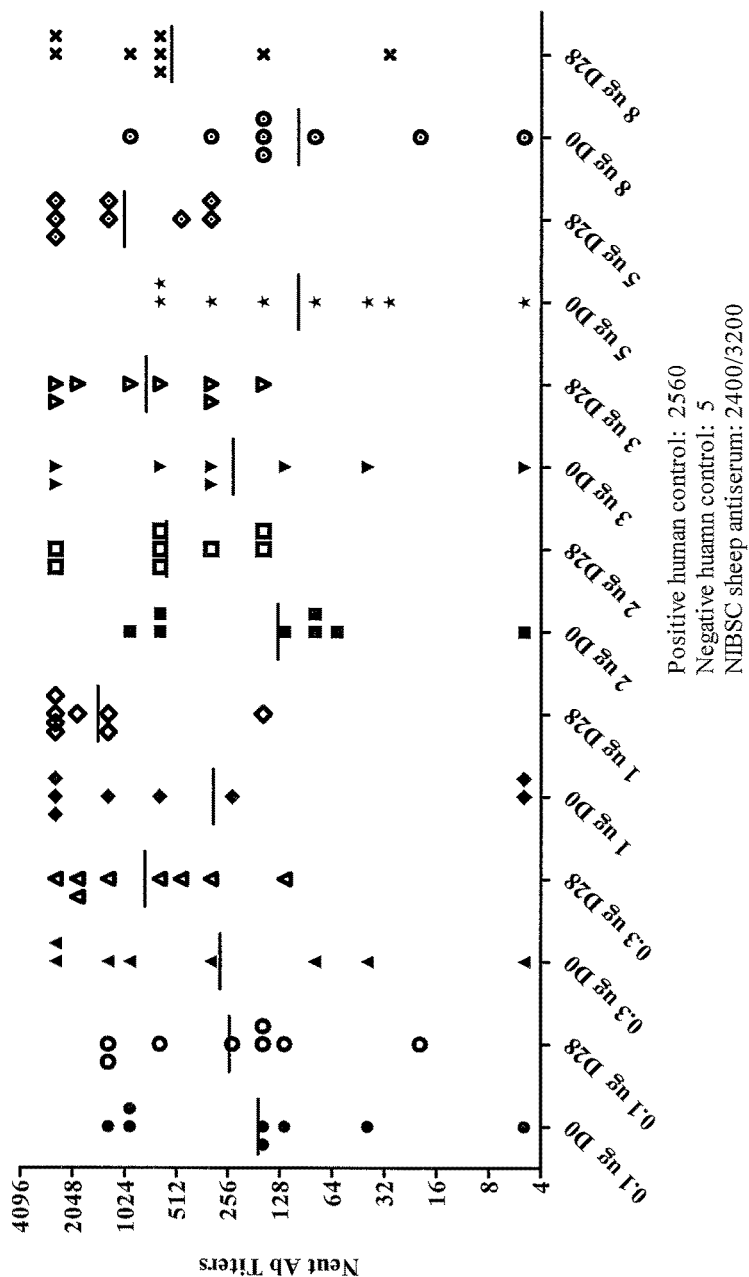
FIG. 36 depicts microneutralization titers for VAX125 clinical serum. Serum samples were mixed with Solomon Islands virus and then added to MDCK cells. After 20 hours incubation, virus replication was quantified by lysing cells and staining for expression of nucleoprotein (NP). Microneutralization titers were determined as the highest dilution which reduced virus replication by ≥50%. Results are shown as individual subject titers with the bar representing the group geometric mean.
Figure 37A:
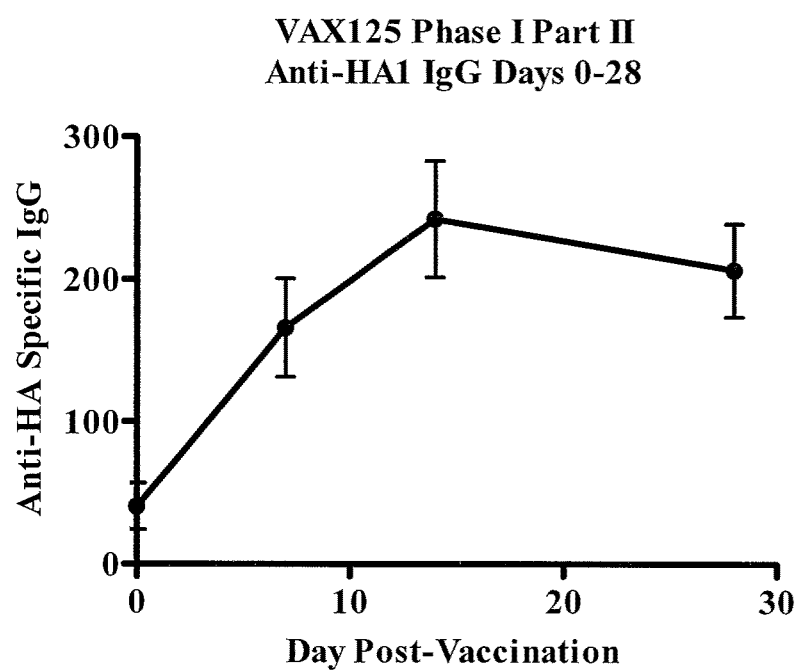
FIGS. 37A and 37B depict HA- and flagellin specific IgG by ELISA. Serum were diluted and incubated on plates coated with either recombinant HA1-1 or STF2. Antigen-specific IgG was detected using anti-human HRP and TMB. Specific IgG was calculated from a standard curve using a 4 parameter logistic equation. Data are shown as group mean with error bars representing standard error of the mean (SEM).
Figure 37B:
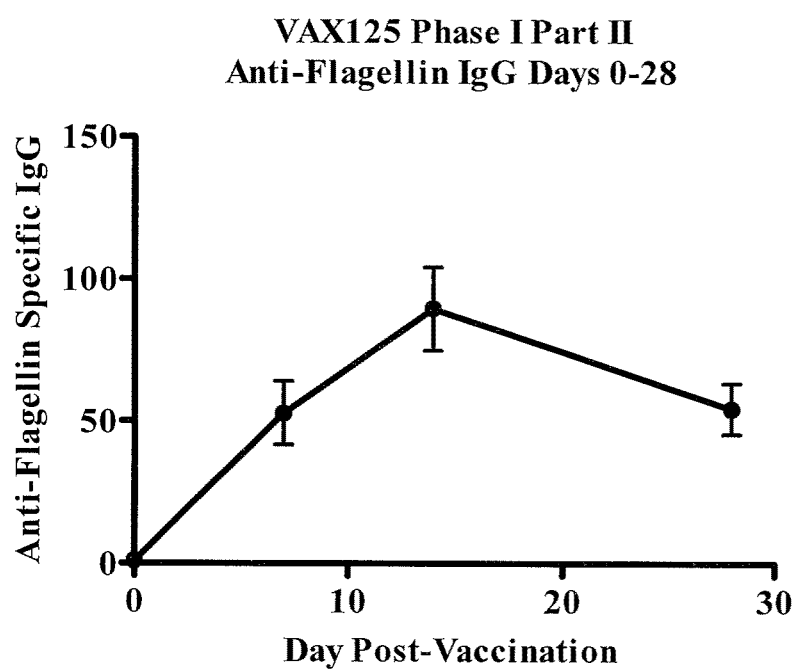

In addition to the HAI assay, microneutralization and ELISA assays were performed. As shown in FIG. 36 for Part 1 subjects, the microneutralization assay results are comparable to the HAI results: significant preadministration titers were observed (D0) but doses of VAX125 from 0.3 µg to 8 µg caused increases in the microneutralization titers by Day 28 (D28). As shown in FIGS. 37A and B, for Part 2 subjects, anti-HA specific IgG, which was measurable preadministration of the fusion protein, rose from Days 0 to 7, and reached a plateau by Day 14. Anti-flagellin IgG began at a lower concentration but increased with similar kinetics to the anti-HA response.

Conclusions

VAX125 was highly immunogenic after a single intramuscular dose at doses ranging from 0.1 µg to 8 µg. Doses in the 1 µg to 3 µg range produced immune responses comparable or better to the standard antigen given at doses of 15 µg. These data show that the HA globular head protein of influenza can be expressed in *E. coli* and when it is fused to flagellin is highly immunogenic. One person in the 3 µg group had a systemic side effect indicative of cytokine release, which may be a consequence of TLR5 stimulation of the innate immune system.

Appreciable increases in HAI titer, microneutralization and HA-specific IgG were seen at all doses at or above 1 µg. Increases were also seen at 0.1 µg and 0.3 µg but while the measurable preadministration titers might have reduced the seroconversion rate, 100% of subjects were seroprotected at these doses.

```
Amino acid sequence of STF2.HA1 (SI

```
651 LYHKENAYVS VVSSHYSRKF TPEIAKRPKV RDQEGRINYY WTLLEPGDTI

701 IFEANGNLIA PRYAFALSRG FGSGIINS
```

STF2

SEQ ID NO: 661

```
  1 AQVINTNSLS LLTQNNLNKS QSALGTAIER LSSGLRINSA KDDAAGQAIA

51 NRFTANIKGL TQASRNANDG ISIAQTTEGA LNEINNNLQR VRELAVQSAN

101 STNSQSDLDS IQAEITQRLN EIDRVSGQTQ FNGVKVLAQD NTLTIQVGAN

151 DGETIDIDLK QINSQTLGLD SLNVQKAYDV KDTAVTTKAY ANNGTTLDVS

201 GLDDAAIKAA TGGTNGTASV TGGAVKFDAD NNKYFVTIGG FTGADAAKNG

251 DYEVNVATDG TVTLAAGATK TTMPAGATTK TEVQELKDTP AVVSADAKNA

301 LIAGGVDATD ANGAELVKMS YTDKNGKTIE GGYALKAGDK YYAADYDEAT

351 GAIKAKTTSY TAADGTTKTA ANQLGGVDGK TEVVTIDGKT YNASKAAGHD

401 FKAQPELAEA AAKTTENPLQ KIDAALAQVD ALRSDLGAVQ NRFNSAITNL

451 GNTVNNLSEA RSRIEDSDYA TEVSNMSRAQ ILQQAGTSVL AQANQVPQNV

501 LSLLA
``` amino acid sequence of STF2.his6

SEQ ID NO: 663

MAQVINTNSLSLLTQNNLNKSQSALGTAIERLSSGLRINSAKDDAAGQA

IANRFTANIKGLTQASRNANDGISIAQTTEGALNEINNNLQRVRELAVQ

SANSTNSQSDLDSIQAEITQRLNEIDRVSGQTQFNGVKVLAQDNTLTIQ

VGANDGETIDIDLKQINSQTLGLDSLNVQKAYDVKDTAVTTKAYANNGT

TLDVSGLDDAAIKAATGGTNGTASVTGGAVKFDADNNKYFVTIGGFTGA

DAAKNGDYEVNVATDGTVTLAAGATKTTMPAGATTKTEVQELKDTPAVV

SADAKNALIAGGVDATDANGAELVKMSYTDKNGKTIEGGYALKAGDKYY

AADYDEATGAIKAKTTSYTAADGTTKTAANQLGGVDGKTEVVTIDGKTY

NASKAAGHDFKAQPELAEAAAKTTENPLQKIDAALAQVDALRSDLGAVQ

NRFNSAITNLGNTVNNLSEARSRIEDSDYATEVSNMSRAQILQQAGTSV

LAQANQVPQNVLSLLRHHHHHH amino acid sequence of HA1-1 (SI)

SEQ ID NO: 662

SHNGKLCLLKGIAPLQLGNCSVAGWILGNPECELLISRESWSYIVEKPN

PENGTCYPGHFADYEELREQLSSVSSFERFEIFPKESSWPNHTTTGVSA

SCSHNGESSFYKNLLWLTGKNGLYPNLSKSYANNKEKEVLVLWGVHHPP

NIGDQRALYHKENAYVSVVSSHYSRKFTPEIAKRPKVRDQEGRINYYWT

LLEPGDTIIFEANGNLIAPRYAFALSRGFGSGIINSNAPMDECDAKCQT

PQGAINSSLPFQNVHPVTIGECPKYVR amino acid sequence of HA (SI)

SEQ ID NO: 665

MKVKLLVLLCTFTATYADTICIGYHANNSTDTVDTVLEKNVTVTHSVNL

LEDSHNGKLCLLKGIAPLQLGNCSVAGWILGNPECELLISRESWSYIVE

KPNPENGTCYPGHFADYEELREQLSSVSSFERFEIFPKESSWPNHTTTG

VSASCSHNGESSFYKNLLWLTGKNGLYPNLSKSYANNKEKEVLVLWGVH

HPPNIGDQRALYHKENAYVSVVSSHYSRKFTPEIAKRPKVRDQEGRINY

YWTLLEPGDTIIFEANGNLIAPRYAFALSRGFGSGIINSNAPMDECDAK

```
-continued
CQTPQGAINSSLPFQNVHPVTIGECPKYVRSAKLRMVTGLRNIPSIQSR

GLFGAIAGFIEGGWTGMVDGWYGYHHQNEQGSGYAADQKSTQNAINGIT

NKVNSVIEKMNTQFTAVGKEFNKLERRMENLNKKVDDGFIDIWTYNAEL

LVLLENERTLDFHDSNVKNLYEKVKSQLKNNAKEIGNGCFEFYHKCNDE

CMESVKNGTYDYPKYSEESKLNREKIDGVKLESMGVYQILAIYSTVASS

LVLLVSLGAISFWMCSNGSLQCRICI
```

Example 9

Administration of STF2.4xM2e in Humans—Dose Range and Routes of Administration

In order to determine the safety and immunogenicity of STF2.4xM2e (SEQ ID NO: 664) in F105 buffer (10 mM Tris, 10 mM L-Histidine, 5% sucrose (w/w), 75 mM NaCl, 0.02% polysorbate-80 (w/w), 0.1 mM EDTA, 0.41% (w/w) ethanol at pH 7.2) Phase I clinical trials were performed. The STF2.4xM2e fusion protein in F105 buffer is a composition referred to herein a "VAX102." One hundred fifty six (156) subjects 18-49 years old were enrolled in multicenter, double-blind, randomized, placebo-controlled trials to assess VAX102 doses ranging from 0.03-10 μg.

VAX102 and placebo was administered intramuscularly (i.m.), subcutaneously (s.c.), or intradermally (i.d.) at 0 and 28 days. Clinical and laboratory safety assessments took place 1 and 7 days after immunization. Immune responses to M2e and flagellin were assessed by ELISA at 7, 14 and 28, 35, 42, 60, 120 and 180 days after each dose. Seroconversion was defined as a serum IgG anti-M2e antibody value greater than or equal to 0.174 μg/ml and a four-fold rise in titer.

Materials and Methods

Study Design

Three studies were conducted to assess the safety, tolerability and immunogenicity of VAX102. The first Phase I clinical study (referred to herein as "VAX102-01") was conducted with doses 0.3 μg, 1.0 μg, 3.0 μg and 10 μg administered i.m. The second Phase I clinical study (referred to herein as "VAX102-02") was conducted with doses 0.03 μg and 0.1 μg either i.m. or i.d. A third Phase I clinical study (referred to herein as "VAX102-03") was conducted with doses of 0.3 μg (i.m., s.c, or i.d.), 1 μg (i.m., s.c. or i.d.) and 2 μg (i.m. or s.c.). The trials were registered with ClinicalTrials.gov number NCT00603811.

Study Participants

Subjects were 18-49 years of age and healthy as ascertained by medical history, screening physical examination and screening laboratory analysis. The main exclusion criteria included history of active medical condition or presence of abnormal screening laboratory results, impaired immune response for any reason, documented influenza infection within the previous 6 months, recent receipt of non-study vaccine, or allergy to the components in the composition.

Procedures

In the first study, participants were randomly assigned to receive 2 doses of either VAX102 or placebo at a ratio of 3 VAX102 recipients to 1 placebo recipient. Study materials were prepared by non-blinded pharmacists and provided to blinded clinical staff. Study participants received the identically appearing VAX102/placebo by intramuscular injection in the deltoid muscle of the non-dominant arm. Participants maintained a memory aide following each dose of VAX102, and for 6 days thereafter, on which they recorded solicited local and systemic reactions graded as none, mild, moderate, or severe. Adverse reactions were assessed by study participants using a 4 point scale (0-3). Solicited local reactions were redness, swelling or induration, pain and ecchymosis. Solicited systemic reactions were fever, headache, joint pain, fatigue, muscle aches, shivering (chills) and increased sweating.

Subjects returned to the clinic for safety observations on Days 1 and 7 after each administration of VAX102 for a brief physical examination, memory aide review and laboratory assessment. Additional safety laboratory assessments were performed on Days 14, 28, 42, 60, 120 and 180. Laboratory analysis included CBC, BUN, Creatinine, urinalysis and liver function tests. C reactive protein (CRP) assays were performed on Day 0 (pre and 4 hours post vaccination) and 1, 28 (pre and 4 hours post vaccination) and 29 days for all study individuals with the exception of those in 10 μg dose group. Day 0 is the day the VAX102 composition or placebo were administered. IgG responses to M2e and flagellin assays were performed on sera collected on days 0, 7, 14, 28, 35, 42, 60, 120 and 180 following vaccination.

Dose Escalation Procedures (Study 1)

At the end of each dose cohort the safety monitoring committee reviewed the safety data provided by the data management team (Veristat, Inc, MA). The protocol was initially designed with the 10 μg dose as the first dose. High levels of reactogenicity were found in several subjects following the first dose of VAX102 at this level and the study was halted until the immunogenicity results were available. CRP assays were performed at Day 1 following VAX102 when possible once the reactogenicity was identified. Favorable immune responses led to redesign of the protocol to examine lower doses ranging from 0.3 to 3 μg. The revised protocol was modified to provide for an on-site observation period of 4 hours following the first dose of VAX102 and follow up at the clinic on Day 1 and Day 29 for safety assessment and CRP. The data with regard to reactogenicity and the redesign of the protocol were reviewed and approved by and Independent Data and Safety monitoring board and the respective institutional review boards.

Within each dose group, upon completion of the 7 day memory aides and safety labs at Days 1, 7 and 14, data were reviewed by the safety monitoring committee. This committee was comprised of principal investigators from each site, the sponsor's medical officer and an independent safety monitor. All decisions with regard to dose escalation were determined by agreement of the members of this committee.

Upon completion of the dose escalation portion of the initial study, the protocol allowed for the enrollment of 16 additional subjects at the dose determined to have optimal safety and immunogenicity.

Study 2

After the Day 60 visits in study 1, two groups of 8 subjects were enrolled in a second study and administered doses of 0.03 and 0.1 μg given either intramuscularly or intradermally. Additional study activities were similar to those in Study 1, with the exception that there was no blinding and no individuals received placebo.

Study 3

Eight groups of 8 subjects were enrolled in a third study in which doses of 0.3, 1, and 2 μg were administered intramuscularly, subcutaneously or intradermally. The study procedures in this third study were as outlined above with regard to inclusion and exclusion criteria. Other study activities were similar to those in Studies 1 and 2, with the exception that there was no blinding and no individuals received placebo.

The Composition Administered to Humans

STF2.4xM2e(Hu) (SEQ ID NO: 664) consists of four tandem repeats of the ectodomain of influenza A virus matrix protein M2 (M2e) fused to the C-terminus of the full-length sequence of Salmonella typhimurium fljB (a TLR5 ligand). The STF2.4xM2e(Hu) (SEQ ID NO: A) gene encodes an N-terminal methionine residue that was proteolytically cleaved upon expression in E. coli. Intact STF2.4xM2e(Hu), as purified from E. coli, contains 610 amino acid residues with a molecular mass of 64,077 Daltons. The amino acid sequence of STF2.4xM2e(Hu) is shown in SEQ ID NO:A). A plasmid encoding this product (pET/STF2.4xM2e) under lac operon control was transformed into E. coli strain BLR (DE3) (Novagen-EMD, San Diego, Calif.). Recombinant bacteria was cultured in a synthetic medium and protein induced using IPTG. Material was purified under GMP conditions using standard methods of chromatography (Avecia, Billingham, UK). This material was formulated in buffer F105 (10 mM Tris, 10 mM L-Histidine, 5% sucrose (w/w), 75 mM NaCl, 0.02% polysorbate-80 (w/w), 0.1 mM EDTA, 0.41% (w/w) ethanol at pH 7.2), and administered to human subjects in a series of clinical trials.

M2e Clinical ELISA

For the performance of the clinical M2e ELISA, the binding of human serum samples to M2e-coated plates was compared to a standard curve of human polyclonal IgG. The curve was fit using a 4-parameter logistic equation in Softmax Pro 5.2 (Molecular Devices, Sunnyvale, Calif.). Pooled positive and negative control sera were run on each plate. Results of subject and control serum were converted from OD values to M2e-specific IgG using the standard curve and adjusting for dilution. Pass/fail criteria for each assay were established based on both the standard curve performance and the adjusted results of the positive and negative serum.

The human IgG (AbD Serotec, Oxford, UK) was bound to plates (Immunlon 4 HBX Extra high binding, Thermo, Hudson, N.H.) at 4-fold dilutions starting at 3.6 μg/mL. The M2e peptide was identical to the sequence used in the VAX102 STF2.4xM2e (SLLTEVETPIRNEWGSRSNDSSDP; SEQ ID NO: 666, Princeton Biomolecules, Langhorne, Pa.). This peptide was used to coat the plate at 2 μg/mL.

After overnight incubation at 2-8° C., plates were washed and blocked (Pierce Superblock with Tween 20, Thermo, Hudson, N.H.). Dilutions of subject serum were prepared in a separate plate and transferred to M2e-coated plates. After incubation and washing, plates were developed with goat anti-human IgG conjugated horse radish peroxidase (HRP—Jackson ImmunoResearch, West Grove, Pa.), TMB substrate (Pierce One Step, Thermo, Hudson, N.H.) and $H_2SO_4$ stop solution (Mallinckrodt Baker, Phillipsburg, N.J.). Plates were read at 450 nm. Adjusted results were calculated for each subject and bleed date. A sample was considered positive if its adjusted result was >0.174 μg/mL.

STF2 Clinical ELISA

For the performance of the clinical STF2 ELISA, the binding of human serum samples to STF2-coated plates was compared to a standard curve of human polyclonal IgG. The curve was fit using a 4-parameter logistic equation in Softmax Pro 5.2 (Molecular Devices, Sunnyvale, Calif.). Pooled positive control sera were run on each plate. Results of subject and control serum were converted from OD values to STF2-specific IgG using the standard curve and adjusting for dilution. Pass/fail criteria for each assay were established based on both the standard curve performance and the adjusted results of the positive serum.

The human IgG (AbD Serotec, Oxford, UK) was bound to plates (Immunlon 4 HBX Extra high binding, Thermo, Hudson, N.H.) at 4-fold dilutions starting at 3.6 μg/mL. The STF2 protein was identical to the sequence used in the VAX102 STF2.4xM2e (STF2.4xM2e). This protein was used to coat the plate at 1 μg/mL.

After overnight incubation at 2-8° C., plates were washed and blocked (Pierce Superblock with Tween 20, Thermo, Hudson, N.H.). Dilutions of subject serum were prepared in a separate plate and transferred to STF2-coated plates. After incubation and washing, plates were developed with goat anti-human IgG conjugated horse radish peroxidase (HRP—Jackson ImmunResearch, West Grove, Pa.), TMB substrate (Pierce One Step, Thermo, Hudson, N.H.) and $H_2SO_4$ stop solution (Mallinckrodt Baker, Phillipsburg, N.J.). Plates were read at 450 nm. Adjusted results were calculated for each subject and bleed date.

Statistical analyses were performed at the two-sided significance level of $\alpha=0.05$ unless otherwise stated. Placebo subjects from all dose groups and VAX102 subjects receiving the same dose were pooled for summaries and analyses. No adjustments were made for multiple statistical testing. All programs for data output and analyses were written in SAS® version 9.1 (SAS Institute, Cary, N.C.).

Safety and tolerability analyses included all subjects from both studies and included descriptive statistics. Chi-square tests for categorical data and analysis of variance for continuous data was used to determine differences in baseline characteristics. Frequency of vaccination site abnormalities; incidence of local and systemic AEs and their relationship to the study drug; and changes in clinical laboratory results, vital signs, and physical examination findings were the primary safety measures. Rates of reactions were compared using Fisher's Exact and Cochran Mantal-Haenszel methods.

Serology:

M2e specific IgG antibody titration curves were established at each time point. Least squares means analyses were used to distinguish significant differences in antibody titers. All analyses were based upon a per-protocol cohort with additional analysis performed for the intent-to-treat (ITT) cohort. The per-protocol cohort was defined as all volunteers who completed 2 immunizations. The primary immunogenicity population consisted of all subjects who received both doses of study treatment and have baseline and Day 60 for study 1 and day 42 for study 2 anti-M2e serum antibody titers. Seroconversion was defined as an M2e value greater than or equal to 0.174 and a four fold rise in titer. Geometric means were determined for each dose and time point. Rates of seroconversion were assessed using a logistic regression model.

Results

A total of 156 individuals were enrolled in Phase I clinical studies 1, 2 and 3. In study 1, 60 subjects were randomized to receive VAX102 at doses of 0.3, 1.0, 3 and 10 μg (n=44) or placebo (n=16), by i.m. injection. In study 2, 32 subjects were enrolled to receive either 0.03 or 0.1 μg of VAX102 given either i.m or i.d. In study 3, 64 subjects were enrolled to receive either 0.3, 1 or 2 μg of VAX102 i.m. or s.c. and either 0.3 or 1 μg i.d. Sixteen (16) individuals in study 1 did not receive the booster dose of VAX102, due to change in protocol design following AE's at the 10 μg dose. The baseline characteristics of the subjects in Studies 1 and 2 are shown in Table 17. The mean age was 31.7 years, women accounted for 59% of the subjects and white race accounted for 78% of subjects. In study 1 the subjects were enrolled at two clinical sites, the site in Kansas enrolled 68% of subjects. All subjects were enrolled at the clinical site in Kansas in studies 2 and 3.

TABLE 17

Baseline characteristics of study subjects in VAX102-01/102-02 by dose group, expressed as number (%)

|  | Placebo (n = 16) | 0.03 μg (n = 8) | 0.1 μg (n = 8) | 0.3 μg (n = 6) | 1 μg (n = 18) | 3 μg (n = 6) | 10 μg (n = 14) | Total 76 |
|---|---|---|---|---|---|---|---|---|
| Age[1] (mean) | 32.8 | 35.4 | 35.0 | 28.7 | 32 | 32.7 | 26.8 | 30.7 |
| Male[2] | 5 (31) | 4 (50) | 3 (37.5) | 2 (33) | 8 (44) | 4 (67) | 5 (36) | 31 (41) |
| Female | 11 (69) | 4 (50) | 5 (62.5) | 4 (67) | 10 (56) | 2 (33) | 9 (64) | 45 (59) |
| White[2] | 12 (75) | 7 (87.5) | 6 (75) | 4 (67) | 15 (83) | 5 (83) | 11 (79) | 60 (79) |
| Black | 3 (19) | 1 (12.5) | 1 (12.5) | 2 (33) | 1 (6) | 1 (27) | 3 (21) | 12 (16) |
| Other | 1 (6) | 0 | 1 (12.5) | 0 | 2 (11) | 0 | 0 | 4 (5) |

[1]NS based on analysis of variance
[2]NS based on chi-square test

VAX102 Safety

VAX102 at doses of 0.03 μg, 0.1 μg, 0.3 μg, and 1 μg was well tolerated in all subjects when given i.m., s.c., or i.d. Additionally, 2 μg doses of VAX102 were well tolerated when given s.c. As shown in Table 18A for subjects given i.m. doses in Studies 1 and 2, VAX102 at higher doses was associated with higher levels of reactogenicity that was statistically significant ($p<0.05$) after the first dose. Significant reactogenicity was not seen after the boost (Table 18B). There were no serious adverse events during the study period in any individual at any dose.

TABLE 18A

Local and systemic symptoms after the first dose of VAX 102-01/102-02 or placebo

| Dose | Placebo n = 16 | 0.03 μg n = 8 | 0.1 μg n = 8 | 0.3 μg n = 6 | 1 μg n = 18 | 3 μg n = 6 | 10 μg n = 14 |
|---|---|---|---|---|---|---|---|
| Local[1] | | | | | | | |
| None | 11 (69) | 2 (25) | 2 (25) | 1 (17) | 3 (17) | 0 | 0 |
| Mild | 5 (31) | 3 (37.5) | 3 (37.5) | 2 (33) | 10 (56) | 3 (50) | 5 (36) |
| Moderate | 0 | 3 (37.5) | 3 (37.5) | 3 (50) | 5 (28) | 3 (50) | 8 (57) |
| Severe | 0 | 0 | 0 | 0 | 0 | 0 | 1 (7) |
| Systemic[2] | | | | | | | |
| None | 9 (56) | 6 (75) | 4 (50) | 4 (67) | 6 (33) | 2 (33) | 0 |
| Mild | 4 (25) | 2 (25) | 4 (50) | 2 (33) | 9 (50) | 0 | 2 (14) |
| Moderate | 2 (13) | 0 | 0 | 0 | 3 (17) | 4 (67) | 6 (43) |
| Severe | 1 (6) | 0 | 0 | 0 | 0 | 0 | 6 (43) |

[1]Local: injection site pain, redness, bruising or induration
[2]Systemic: headache, fatigue, joint pain, muscle aches, chills and sweats

TABLE 18B

Local and systemic symptoms after the second dose of VAX 102-01/102-02 or placebo

| Dose | Placebo n = 11 | 0.03 μg n = 8 | 0.1 μg N = 8 | 0.3 μg n = 6 | 1 μg n = 18 | 3 μg n = 6 | 10 μg n = 3 |
|---|---|---|---|---|---|---|---|
| Local | | | | | | | |
| None | 10 (91) | 2 (25) | 5 (37.5) | 5 (83) | 13 (72) | 4 (67) | 1 (33) |
| Mild | 1 (9) | 6 (75) | 2 (25) | 1 (17) | 5 (28) | 2 (33) | 2 (67) |
| Moderate | 0 | 0 | 1 (12.5) | 0 | 0 | 0 | 0 |
| Severe | 0 | 0 | 0 | 0 | 0 | 0 | 0 |
| Systemic | | | | | | | |
| None | 11 (100) | 7 (87.5) | 6 | 5 (83) | 14 (78) | 5 (83) | 2 (67) |
| Mild | 0 | 0 | 1 (12.5) | 0 | 4 (22) | 1 (17) | 1 (33) |
| Moderate | 0 | 1 (12.5) | 0 | 1 (17) | 0 | 0 | 0 |
| Severe | 0 | 0 | 1 (12.5) | 0 | 0 | 0 | 0 |

Dose Formulations 0.03, 0.1, 0.3 and 1 µg

The rates and severities of local and systemic reactions reported by the study subjects administered i.m. doses in Studies 1 and 2 are shown in Tables 18A for the first dose and Table 18B for the second dose. Tables 18A and 18B depict the highest level of severity of symptom in each category reported by a subject. Following the first dose, local symptoms were predominantly categorized as mild to moderate during the 7 day observation period following vaccination. Local symptoms resolved with 1 to 2 days after vaccination. Mild headache, fatigue or muscle aches were the most common systemic symptoms and were similar in frequency to those reported in the placebo group during the 7 day observation period following vaccination. All systemic symptoms resolved within 12-18 hours following VAX102. Local and systemic symptoms were reported more frequently after the first dose than the second given in the same arm 28 days later (Tables 18A and 18B). Similar reactogenicity profiles were seen following the first dose by intradermal administration in Study 3 as shown in Table 18C.

TABLE 18C

Local and systemic symptoms after intradermal injection of VAX102

|  | Dose 1, 0.3 µg Symptom severity | | | Dose 1, 1.0 µg Symptom severity | | |
|---|---|---|---|---|---|---|
|  | None | Mild | Mod. | None | Mild | Mod. |
| Temp. >100° F. | 8 | 0 | 0 | 8 | 0 | 0 |
| Redness | 5 | 3 (38) | 0 | 2 | 6 (75) | 0 |
| Swelling | 8 | 0 | 0 | 4 | 4 (50) | 0 |
| Bruising | 8 | 0 | 0 | 8 | 0 | 0 |
| Arm pain | 1 | 6 (75) | 1 (13) | 1 | 6 (75) | 1 (13) |
| Headache | 7 | 1 (13) | 0 | 4 | 2 (25) | 2 (25) |
| Fatigue | 5 | 3 | 0 | 3 | 3 | 2 (25) |
| Joint Pain | 7 | 1 (13) | 0 | 7 | 1 (13) | 0 |
| Muscle aches | 6 | 2 (25) | 0 | 7 | 0 | 1 (13) |
| Chills | 8 | 0 | 0 | 8 | 0 | 0 |
| Sweating | 8 | 0 | 0 | 8 | 0 | 0 |

Dose Formulations 3 and 10 µg

Vaccination with doses at 3 and 10 µg was associated with higher levels of local and systemic symptoms following the first dose. One subject in the 10 µg group reported severe local reaction and more than half in each dose group reported moderate local reactions (Table 18A). Four of 6 subjects in the 3 µg group reported moderate systemic symptoms with an onset 6 to 8 hours after inoculation and resolved within 12-18 hours. In the 10 µg group systemic symptoms, consisting of headache, muscle aches, fatigue, and chills, began about 2 hours after injection and subsided in 4 to 5 hours with 6 of 14 subjects describing the symptoms as severe (Table 18A). In contrast, the second dose was well tolerated in the 6 subjects who received the 3 µg dose and 3 subjects who received the 10 µg dose.

Safety Laboratory Studies

CRP levels demonstrated a dose related elevation on day 1 (Studies 1 and 2 i.m. data shown in Table 19). In the 3 µg group, the average CRP was 2.7 mg/dL (range 0.5 to 5.8). In the 10 µg group CRPs were not routinely obtained on the day after the injection, however CRPs were obtained from 6 subjects as part of an evaluation of moderate to severe systemic reactogenicity on Day 1. In this group, the mean CRP was 6.4 (range 3.9 to 12.5 mg/dL). Three subjects in the 10 µg group had elevated white blood counts with left shift and one had elevated liver function tests after the first dose (data not shown). At the lower doses of 0.03 µg and 0.1 µg given i.d., only baseline levels of CRP were seen (Table 19B). Similar CRP levels were induced by i.m., or s.c. injections of 0.3 µg, 1 µg and 2 µg or i.d. injection of 0.3 µg or 1 µg of VAX102 in Study 3 (Table 21).

TABLE 19A

C-reactive protein (mean value in mg/dL) before and after i.m. vaccination with VAX102-01/102-02

| Dose (µg) | Number of subjects | First dose | | Second dose | |
|---|---|---|---|---|---|
|  |  | Day 0 | Day 1 | Day 28 | Day2 9 |
| Placebo | 10 | 0.3 | 0.3 | 0.3 | 0.3 |
| 0.03 | 8 | 0.2 | 0.2 | 0.2 | 0.2 |
| 0.1 | 8 | 0.2 | 0.3 | 0.3 | 0.3 |
| 0.3 | 6 | 0.2 | 0.6 | 0.2 | 0.2 |
| 1 | 18 | 0.3 | 1.2 | 0.6 | 0.6 |
| 3 | 6 | 0.2 | 2.7 | 0.2 | 0.3 |

TABLE 19B

C-reactive protein (mean value in mg/dL) before and after i.d. vaccination with VAX102-01/102-02

| Dose (µg) | Number of subjects | First dose | | Second dose | |
|---|---|---|---|---|---|
|  |  | Day 0 | Day 1 | Day 28 | 2Day 9 |
| 0.03 | 8 | 0.2 | 0.3 | 0.3 | 0.3 |
| 0.1 | 8 | 0.3 | 0.3 | 0.3 | 0.3 |

Immune Response

Figure 38A:
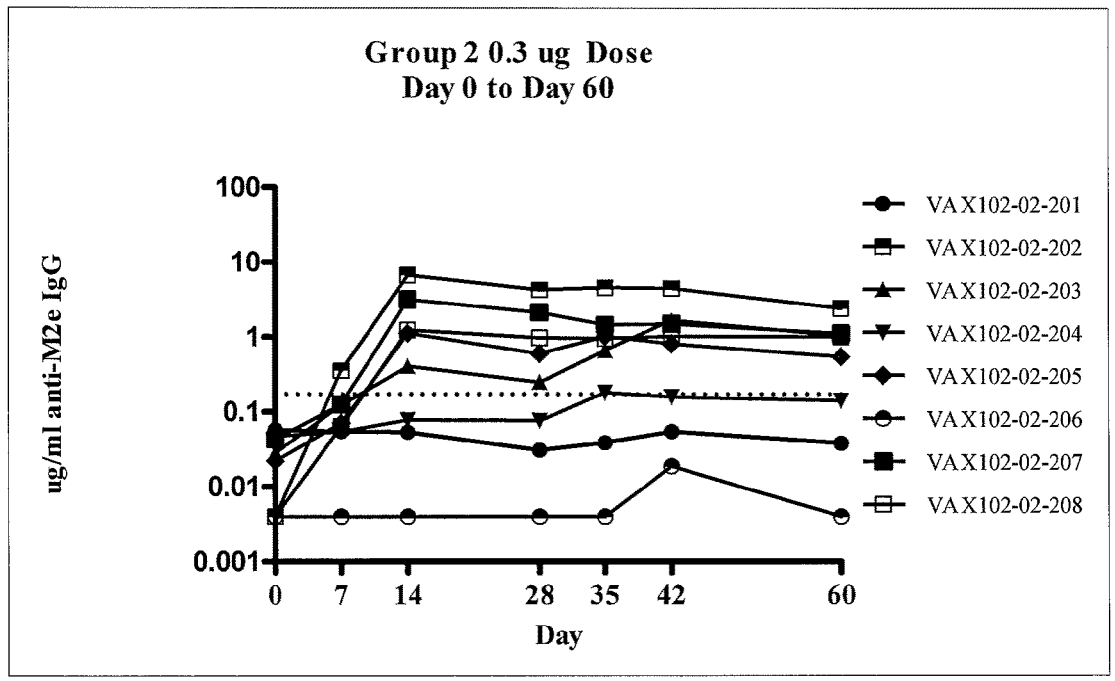
FIGS. 38A and 38B depict M2e-specific IgG following i.m. administration of VAX102 or placebo in individual subjects at 0.3 µg dose and 1.0 µg dose.
Figure 38B:
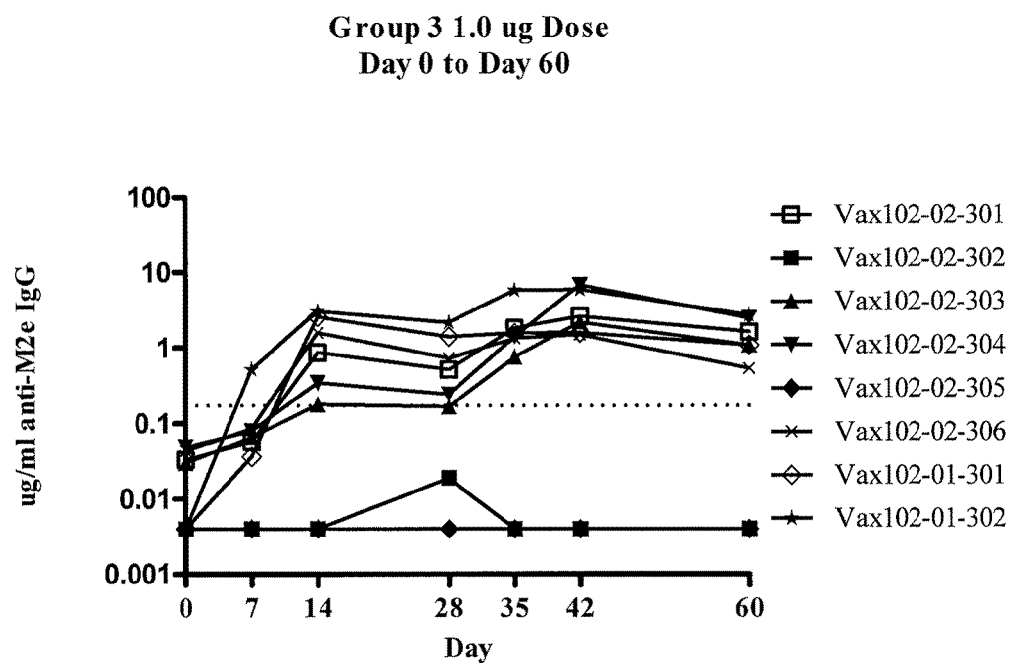

The dose related geometric mean IgG serum antibody responses to i.m. vaccination for M2e and flagellin in Studies 1 and 2 are summarized in Table 20A. On day 0 the M2e antibody titer was barely detectable. All vaccinated subjects showed some degree of M2e antibody response, with a more than 4-fold increase noted in all groups by 14 days after the second dose of VAX102. As shown in FIGS. 38A and 38B, rapid M2e IgG responses were seen in many subjects 7 to 14 days after the prime with 0.3 µg and 1 µg doses. Particularly at the lower dose, the dose response to the first dose was more variable than to the second. Subjects who received a dose of VAX102 of 1 µg showed a booster response to the dose administered on day 28 (FIG. 38B).

TABLE 20A

M2e seroconversion rates* after the first and second doses and geometric mean M2e and flagellin antibody concentrations (µg/ml) at baseline, Days 14 and 42 by dose group, i.m. VAX102-01/102-02

|  |  | Seroconversion rates | |
|---|---|---|---|
| Dose (µg) | No. of subjects | 1st dose n (%) | 2nd dose n (%) |
| Placebo | 16 | 0 (0) | 0 (0) |
| 0.03 | 8 | 1 (13) | 3 (38) |
| 0.1 | 8 | 5 (63) | 6 (75) |
| 0.3 | 6 | 5 (83) | 5 (83) |
| 1 | 18 | 13 (72) | 18 (100) |
| 3 | 6 | 5 (83) | 6 (100) |
| 10 | 14 | 12 (86) | 3 (100) |

|  |  | Geometric mean antibody concentration | | | | |
|---|---|---|---|---|---|---|
|  |  | Serum IgG anti-M2e | | | Serum IgG anti-flagellin | |
| Dose (µg) | No. of subjects | Day 0 | Day 14 | Day 42 | Day 0 | Day 14 | Day 42 |
| Placebo | 16 | 0.01 | 0.01 | 0.02 | 0.3 | 0.4 | 0.2 |
| 0.03 | 8 | 0.04 | 0.08 | 0.18 | 0.9 | 4.4 | 4.4 |

TABLE 20A-continued

M2e seroconversion rates* after the first and second doses and
geometric mean M2e and flagellin antibody concentrations (µg/ml)
at baseline, Days 14 and 42 by dose group, i.m. VAX102-01/102-02

| 0.1 | 8  | 0.02 | 0.18 | 0.36 | 0.4 | 9.4  | 8.9  |
|-----|----|------|------|------|-----|------|------|
| 0.3 | 6  | 0.02 | 0.99 | 1.1  | 0.2 | 24.7 | 12.5 |
| 1   | 18 | 0.01 | 0.36 | 1.7  | 0.1 | 16.9 | 16.9 |
| 3   | 6  | 0.01 | 0.48 | 2.8  | 0.1 | 38.2 | 28.8 |
| 10  | 14 | 0.03 | 0.66 | 2.8  | 0.5 | 40.8 | 60.8 |

*defined as a level ≥0.174 µg/ml and a 4-fold rise in antibody concentration

Figure 31:
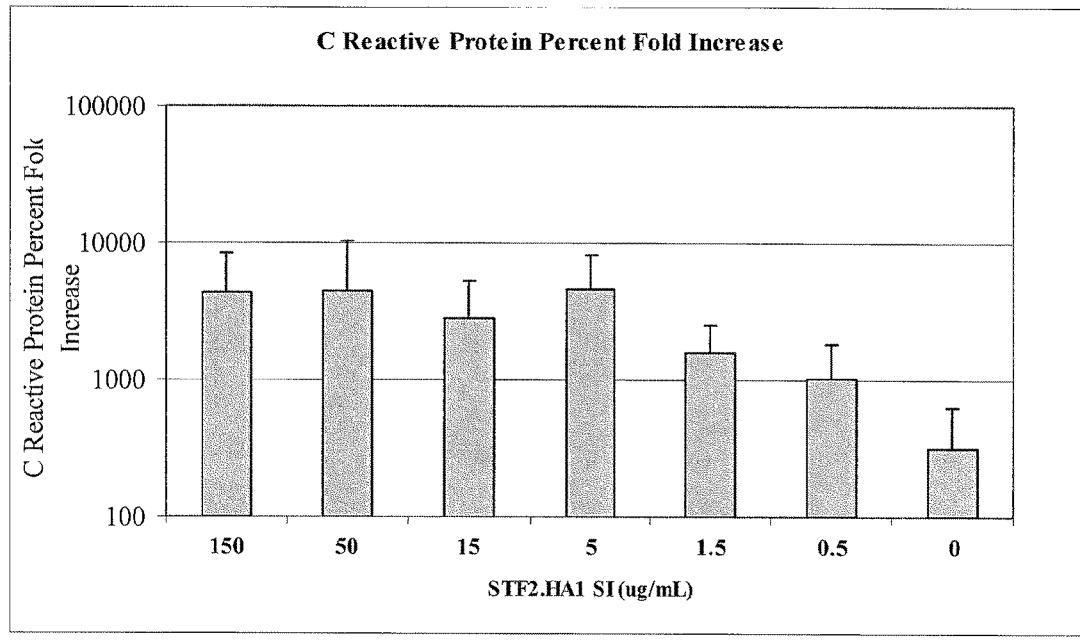
FIG. 31 depicts the effect of STF2.HA1 SI on CRP levels in rabbits. Groups of 6 rabbits were injected i.m. with the indicated dose of STF2.HA1 SI (also known as STF2.HA1-2 (SI)) on day 0. Rabbits were bled 24 hours after vaccination, serum was prepared and CRP was measured (Immunology Consultants Laboratory, Newberg, Oreg.). Data are presented as the group mean CRP+SD.
Figure 32:
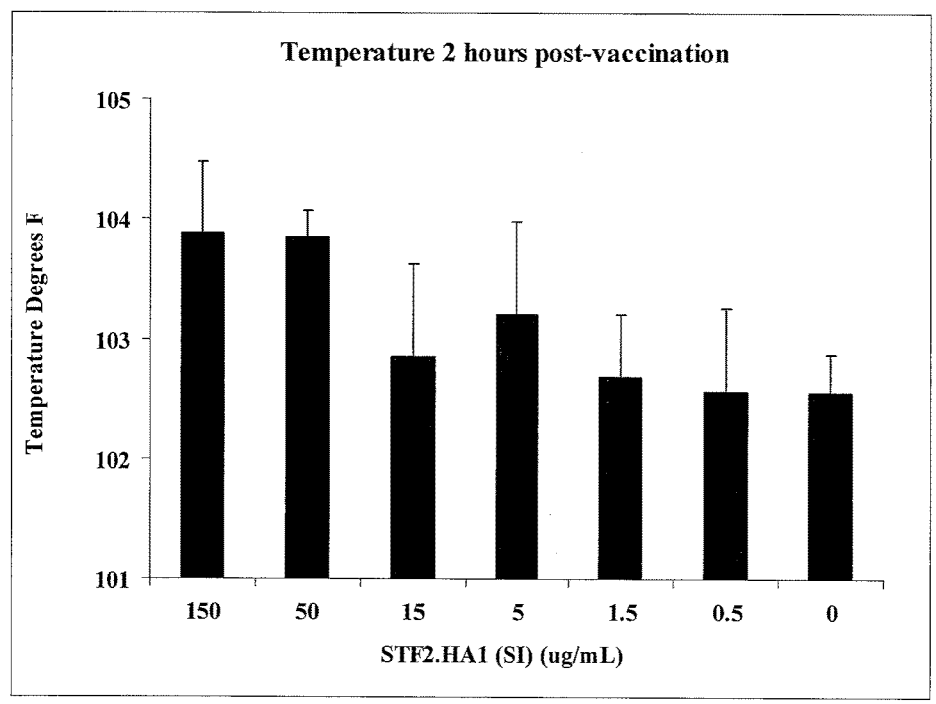
FIG. 32 depicts the effect of STF2.HA1 SI on temperature in rabbits. Groups of 6 rabbits were injected i.m. with the indicated dose of STF2.HA1 SI. Temperature was monitored 2 hours post-vaccination. Data are presented as mean temperature±standard deviation. Baseline temperatures are taken from the group receiving buffer alone and were about 102.5° F.
Figure 33:
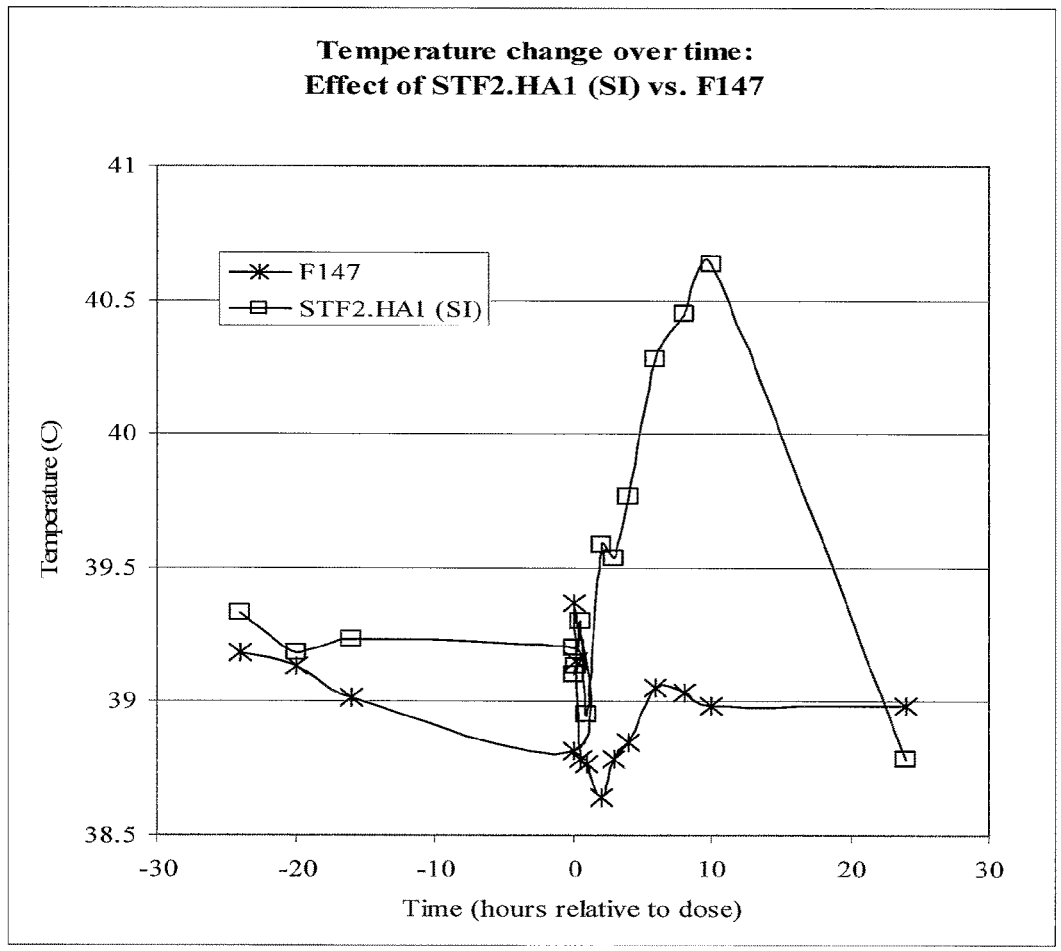
FIG. 33 depicts the temperature increase over time after immunization with STF2.HA1 SI. Rabbits were immunized i.m. with either F147 buffer or 150 µg of STF2.HA1 SI. Temperature was measured at the indicated points using a subcutaneous chip system. Results are presented as group means of 6 animals.
Figure 35:
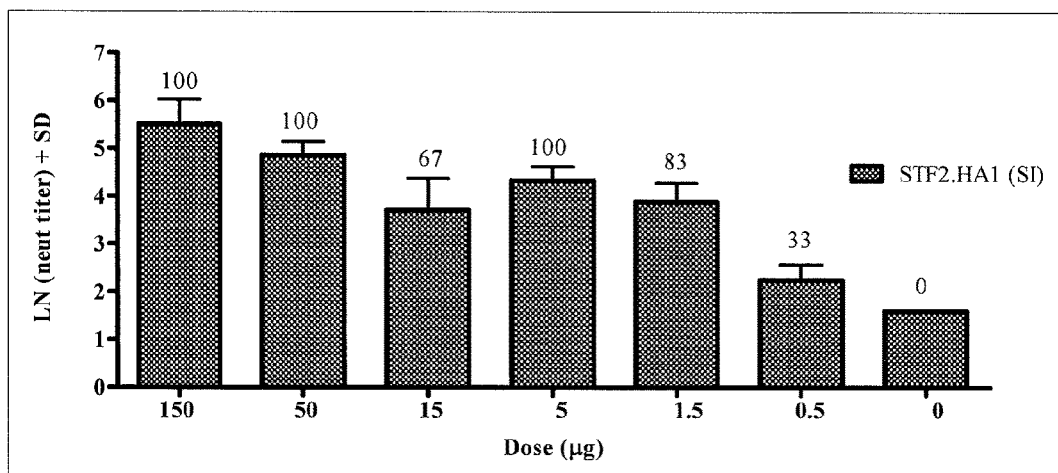
FIG. 35 depicts neutralization of A/Solomon Islands/3/06 by rabbit post-boost immune sera serially diluted, RDE-treated serum samples were co-incubated with A/Solomon Islands/3/2006 virus, then with MDCK cells, and subjected to ELISA with anti-influenza A NP antibody. Neutralizing antibody titers are defined as the reciprocal dilutions that are above the specific signal calculated from the OD values of negative and positive controls. Data represented means±SDs of natural log (LN, neutralizing titer) with responder rates above (N=6).
Figure 39:
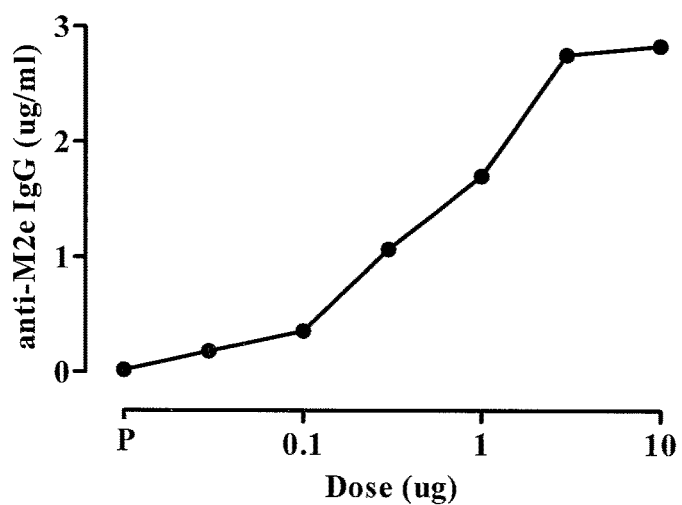
FIG. 39 depicts M2e antibody curve as defined by Geometric Mean Titers (GMT) measured at day 42 after two doses of VAX102 given on Days 0 and 28.
Figure 40:
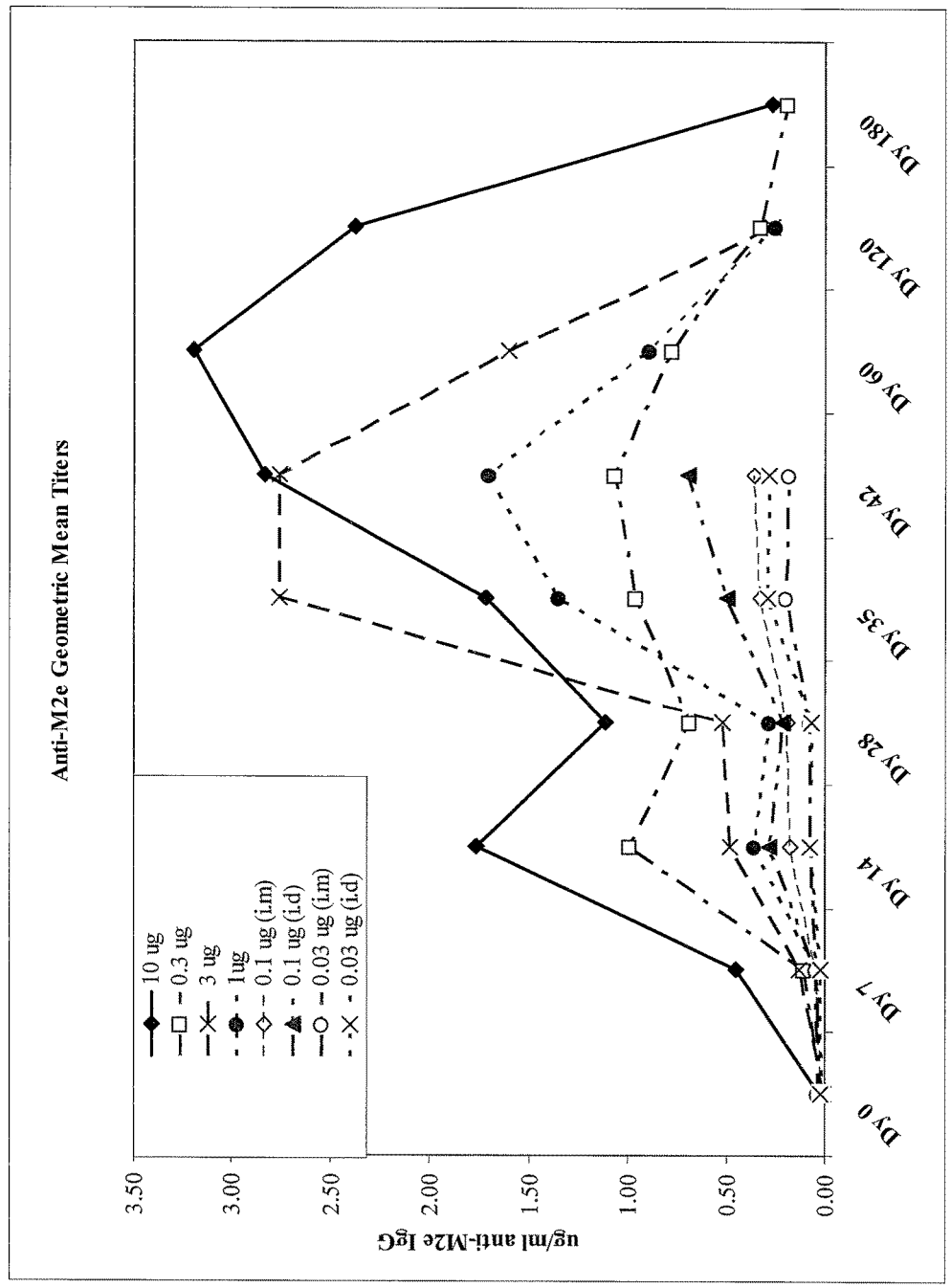
FIG. 40 depicts M2e-specific IgG GMT across multiple dose amounts and routes of administration.
Figure 41A:
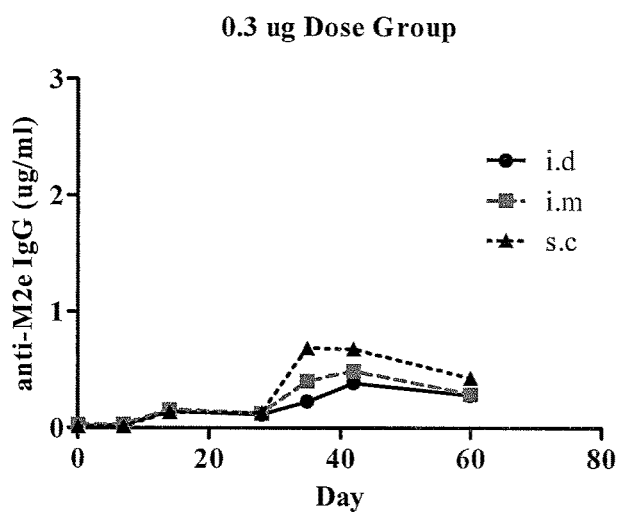
FIGS. 41A-41C depict M2e-specific IgG (group means) in various routes of administration and doses. i.d.=intradermal. s.c.=subcutaneous. i.m.=intramuscular.
Figure 41B:
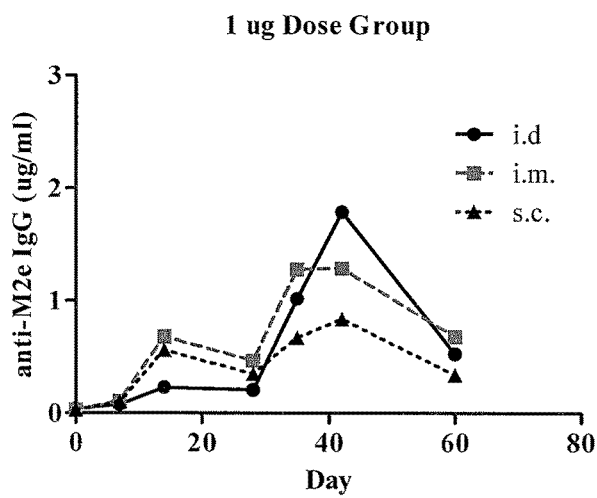
Figure 41C:
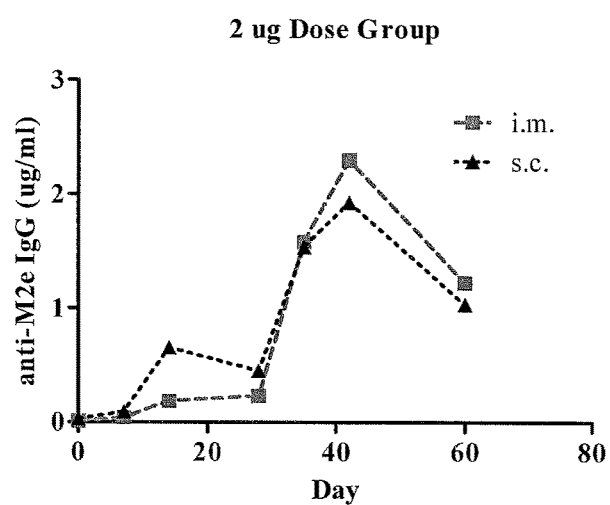

The antibody response after the booster dose showed a consistent dose-related M2e IgG antibody response (Table 20A and FIG. 39). The difference in geometric means among all groups was statistically significant after day 28 (p<0.05). Pairwise comparisons to the placebo group showed that all titers for all doses were greater than placebo at day 42 (p<0.0001). As shown in FIG. 40, a plateau in the antibody curve was observed at the two highest doses (3 and 10 µg). M2e antibody levels peaked at day 42 (14 days after the second dose). M2e antibody levels were still present at day 120 and day 180 at levels ranging from 0.1 to 0.2 µg/ml or about 10 times the antibody concentration at baseline (FIG. 40). As seen in Table 21 and FIGS. 31A-31C, M2e-specific IgG rises above baseline after immunization with 0.3 µg or 1 µg by i.d., i.m. or s.c. routes, as well as i.m. and s.c. immunization at 2 µg. A significant boost effect is seen after day 28.

The baseline antibody levels to flagellin were elevated in many subjects at baseline and vaccination induced a strong dose-related antibody response after the first VAX102 dose (Tables 20A and 20B). The anti-flagellin IgG response to the second dose of VAX102 was less pronounced than that observed for the IgG response to M2e.

The seroconversion rates to i.m. administration are shown in Table 20A. Probability of seroconversion increased with dose at day 42 (p<0.0001). Similar to the GMT's, a dose response is observed at doses ≥0.3 µg where 80% of subjects (35/44) demonstrated seroconversion by this definition after the first dose and 97% (32/33) seroconverted following the second dose. Identical seroconversion rates were seen to 0.03 µg and 0.1 µg prime doses given i.d. (Table 20B). Slightly higher responses to boost were seen i.d. vs. i.m.

TABLE 20B

M2e seroconversion rates* after the first and second doses and
geometric mean M2e and flagellin antibody concentrations (µg/ml)
at baseline, Days 14 and 42 by dose group, i.d. VAX102-01/102-02

| Dose (µg) | No. of subjects | Seroconversion rates | |
|-----------|-----------------|----------------------|---|
|           |                 | 1st dose n (%) | 2nd dose n (%) |
| 0.03      | 8               | 1 (13)         | 6 (75)         |
| 0.1       | 8               | 5 (63)         | 8 (100)        |

| | | Geometric mean antibody concentration | | | | |
|---|---|---|---|---|---|---|
| | | Serum IgG anti-M2e | | | Serum IgG anti-flagellin | | |
| Dose (µg) | No. of subjects | Day 0 | Day 14 | Day 42 | Day 0 | Day 14 | Day 42 |
| 0.03 | 8 | 0.02 | 0.07 | 0.28 | 0.4 | 3.8 | 6.3 |
| 0.1  | 8 | 0.02 | 0.28 | 0.70 | 0.3 | 4.1 | 7.4 |

*defined as a level ≥0.174 µg/ml and a 4-fold rise in antibody concentration

TABLE 21

M2e antibody and CRP

| No. of subjects | Route | Dose (µg) | GM M2e | CRP (mean) | CRP (fold) |
|-----------------|-------|-----------|--------|------------|------------|
| 8 | IM | 0.3 | 0.5 | 0.8 | 1.8 |
| 8 | IM | 1   | 1.3 | 0.8 | 3.1 |
| 6 | IM | 2   | 2.3 | 1.4 | 5.9 |
| 8 | SC | 0.3 | 0.7 | 0.4 | 1.8 |
| 8 | SC | 1   | 0.8 | 0.6 | 2.1 |
| 8 | SC | 2   | 1.9 | 0.8 | 3.2 |
| 8 | ID | 0.3 | 0.4 | 0.4 | 1.3 |
| 8 | ID | 1   | 1.8 | 0.7 | 2   |

Discussion

A composition that includes a fusion protein of flagellin and 4 copies of an ectodomain of human M2 (SEQ ID NO: 664) induces a strong immune response in humans to the M2 ectodomain of influenza A virus. The VAX102 was safe and well tolerated at doses less than 3 µg. Local symptoms were usually mild. The frequency and severity of systemic symptoms were comparable to placebo at doses less than 3 µg. At doses of 3 and 10 µg, a symptom complex consistent with a cytokine response which correlated well with CRP elevation was observed and completely resolved within 24 hours. Flagellin, like other TLR agonists, activates a cytokine response that is considered to be important in orchestrating adaptive immune responses. Interleukin-6 (IL-6) is one of the first cytokines released after stimulation of the TLR5 receptor by flagellin. CRP is an acute phase reactant that is in turn stimulated by IL-6 release. The flagellin component of VAX102 induced a strong, but short-lived cytokine response that caused the symptoms observed at the 3 and 10 µg doses. Due to this profile, doses less than this were used for further evaluation. As expected, although M2e is a component of circulating influenza A virus, all subjects showed negligible titers of M2e antibody prior to vaccination. Seroconversion was demonstrated in all vaccinated subjects following the second vaccination at doses of 1 µg and greater.

Most vaccines for use in humans are compositions of attenuated or killed viruses or bacteria. Generally, vaccines that include purified proteins, such as an influenza vaccine, contain purified HA proteins of about 45 µg per dose (15 µg each of three strains, for example the 2008-09 formulation of Fluvirin® contains 15 mg each of HA from A/Brisbane/59/2007 (H1N1); A/Uruguay/716/2007 (H3N2), an A/Brisbane/10/2007-like strain; and B/Florida/4/2006, Fluvirin® Product Insert, January 2008-2009.

Recombinant protein vaccines have been largely unsuccessful, due to the poor immunogenicity of the isolated proteins in the compositions. There are currently two diseases for which U.S. recombinant protein vaccines exist—Hepatitis B (HBV) and human papillomavirus (HPV). Both preparations form virus-like particles and are delivered absorbed to alum, which serves as an adjuvant. For example, the Engerix® vaccine is given as a 10 µg dose of HBV surface antigen adsorbed to 0.25 mg of alum (Engerix® Product Insert January 2007). In addition, the HPV vaccine Gardasil® which contains 20 µg of HPV 6 L1 protein, 40 µg of HPV 11 L1 protein, 40 µg of HPV 16 L1 protein, and 20 µg of HPV 18 L1 protein adsorbed to 0.225 mg of alum (Gardasil® Product Insert, September 2008). Thus, it is unexpected that STF2.4xM2e, which is a highly purified recombinant protein, delivered without an adjuvant, elicits significant M2e-specific antibody responses at doses equal to or less than about 1 µg.

Amino acid sequence of intact STF2.4xM2e (Hu)

(SEQ ID NO: 664)

```
  1 AQVINTNSLS LLTQNNLNKS QSALGTAIER LSSGLRINSA KDDAAGQAIA

51 NRFTANIKGL TQASRNANDG ISIAQTTEGA LNEINNNLQR VRELAVQSAN

101 STNSQSDLDS IQAEITQRLN EIDRVSGQTQ FNGVKVLAQD NTLTIQVGAN

151 DGETIDIDLK QINSQTLGLD SLNVQKAYDV KDTAVTTKAY ANNGTTLDVS

201 GLDDAAIKAA TGGTNGTASV TGGAVKFDAD NNKYFVTIGG FTGADAAKNG

251 DYEVNVATDG TVTLAAGATK TTMPAGATTK TEVQELKDTP AVVSADAKNA

301 LIAGGVDATD ANGAELVKMS YTDKNGKTIE GGYALKAGDK YYAADYDEAT

351 GAIKAKTTSY TAADGTTKTA ANQLGGVDGK TEVVTIDGKT YNASKAAGHD

401 FKAQPELAEA AAKTTENPLQ KIDAALAQVD ALRSDLGAVQ NRFNSAITNL

451 GNTVNNLSEA RSRIEDSDYA TEVSNMSRAQ ILQQAGTSVL AQANQVPQNV

501 LSLLRLSLLT EVETPIRNEW GSRSNDSSDP LESLLTEVET PIRNEWGSRS

551 NDSSDPGSSL LTEVETPIRN EWGSRSNDSS DPELSLLTEV ETPIRNEWGS

601 RSNDSSDPSR
```

Example 10

DNA Cloning and Protein Expression—Methods

DNA Cloning and Protein Expression in *E. coli*:

Synthetic genes encoding amino acids 66-298 and 130-230 of the glycoprotein (G) (SEQ ID NO: 544) and amino acids 1-194 of the matrix 2 (M2) (SEQ ID NO: 551) proteins from RSV strain A2 were codon optimized for expression in *E. coli* and synthesized by a commercial vendor (DNA 2.0; Menlo Park, Calif.). The genes were designed to incorporate flanking BlpI sites on both the 5' and 3' ends. The gene fragments were excised from the respective plasmids with BlpI and cloned by compatible ends into the STF2Δ.blp vector cassette to generate chimeric sequences joining the RSV antigen sequence in fusion with STF2Δ (SEQ ID NO: 619) a flagellin that lacks at least a portion of a hinge region.

In each case, the constructed plasmids were used to transform competent *E. coli* TOP10 cells and putative recombinants were identified by PCR screening and restriction mapping analysis. The integrity of the constructs was verified by DNA sequencing and plasmid DNA encoding these constructs was used to transform the expression host, BLR (DE3) (Novagen, San Diego, Calif.; Cat#69053). Transformants were selected on plates containing kanamycin (50 μg/mL), tetracycline (5 μg/mL) and glucose (0.5%). Colonies were picked and inoculated into 2 mL of LB medium supplemented with 25 μg/mL kanamycin, 12.5 μg/mL tetracycline and 0.5% glucose and grown overnight. Aliquots of these cultures were used to innoculate fresh cultures in the same medium formulation, which were cultured until an optical density ($OD_{600\,nm}$)=0.6 was reached, at which time protein expression was induced by the addition of 1 mM IPTG and cultured for 3 hours at 37° C. The cells were then harvested and analyzed for protein expression.

DNA Cloning and Protein Expression in *Baculovirus*:

A synthetic gene encoding amino acids 26-524 of the fusion (F) protein from RSV strain A2 (SEQ ID NO: 524) was codon optimized for expression in baculovirus and synthesized by a commercial vendor (DNA 2.0; Menlo Park, Calif.). This sequence included specific mutations designed to prevent endoproteolytic processing of the F protein that normally cleaves the wild-type F protein (SEQ ID NO: 522) into two separate polypeptides during secretion. The genes were designed to incorporate flanking BlpI sites on both the 5' and 3' ends. The gene fragment was excised from the plasmid with BlpI and cloned by compatible ends into the pFastBac vector plasmid (Invitrogen; Carlsbad, Calif.) 3' of a honeybee secretion signal to direct secretion of the recombinant protein into the medium. STF2ng (SEQ ID NO: 613), a flagellin mutated to prevent N-glycosylation (designation "ng" for no glycosylation), was cloned 3' of the F sequences to yield RSVF.STF2ngHis6 (SEQ ID NO: 615) a chimeric fusion joining the F protein sequence to the N-terminus of STF2ng. The C-terminal $His_6$ tag is derived from the vector sequence. The same RSVF sequence was also cloned into the pFastBac vector plasmid (Invitrogen; Carlsbad, Calif.) 3' of a honeybee secretion signal without fusion to STF2ng to yield $RSVFHis_6$ (SEQ ID NO: 617).

After transformation into competent *E. coli* TOP10 cells, putative recombinants were identified by PCR screening and restriction mapping analysis. The integrity of the constructs was verified by DNA sequencing, and recombinant pFastBac plasmid DNA was used to transform the baculovirus genome recombination host, DH10Bac (Invitrogen; Carlsbad, Calif.). Recombinant bacmid transformants were selected by blue-white screening on plates containing X-gal. Colonies were picked and recombination was confirmed by PCR screening. Recombinant bacmid DNA was obtained by midi-prep and used to transfect Sf9 insect cells (Invitrogen; Carlsbad, Calif.). Following titer determination by plaque assays, recombinant baculoviruses were amplified by re-infecting Sf9 cells and the titers determined by plaque assay.

For baculovirus expression of DEN proteins, Hi-5 cells (Invitrogen; Carlsbad, Calif.) were grown to a density of 1×10⁶ cells/ml and infected with recombinant baculovirus at a multiplicity of infection (MOI) of 2. After 24 hours of infection, conditioned medium was harvested by centrifugation. Secreted protein was purified from conditioned medium by Ni-NTA chromatography.

SDS-PAGE and Western Blot:

Protein expression and identity were determined by gel electrophoresis and immunoblot analysis. Cells were harvested by centrifugation and lysed in Laemmli buffer. An aliquot of 10 µl of each lysate was diluted in SDS-PAGE sample buffer with or without 100 mM dithiothreitol (DTT) as a reductant. The samples were boiled for 5 minutes and loaded onto a 10% SDS polyacrylamide gel and electrophoresed by SDS-PAGE. The gel was stained with Coomassie R-250 (Bio-Rad; Hercules, Calif.) to visualize protein bands. For Western Blot, 0.5 ml/lane of cell lysate was electrophoresed and electrotransfered onto a PVDF membrane and blocked with 5% (w/v) dry milk.

For flagellin fusion proteins expressed in E. coli, the membrane was probed with anti-flagellin antibody (Inotek; Beverly, Mass.). After decorating with alkaline phosphatase-conjugated secondary antibody (Pierce; Rockland, Ill.), protein bands were visualized with an alkaline phosphatase chromogenic substrate (Promega, Madison, Wis.).

Bacterial clones which yielded protein bands of the correct molecular weight and reactive with the appropriate antibodies were selected for production of protein for use in biological assays and animal immunogenicity experiments. For RSV F protein constructs expressed in baculovirus, the membrane was probed with alkaline-phosphatase-linked anti-$His_6$ (C-terminal) antibody (Invitrogen; Carlsbad, Calif.) and/or anti-F protein monoclonal antibody.

DNA and protein constructs incorporating RSV antigens are listed in Table 22.

TABLE 22

RSV Antigen Fusion Protein DNA constructs for expression in E. coli and baculovirus:

| Amino acid SEQ ID NO | Nucleotide SEQ ID NO: | Construct Name | Protein predicted molecular weight (Da) |
|---|---|---|---|
| 625 | 626 | STF2Δ.RSVM2 | 51,463 |
| 621 | 622 | STF2Δ.RSVG(130-230) | 40,821 |
| 623 | 624 | STF2Δ.RSVG(66-298) | 54,805 |
| 615 | 616 | RSVF.STF2His$_6$ | 108,465 |
| 617 | 618 | RSVF.His$_6$ | 56,065 |

DNA Cloning—Results

As assayed by Coomassie blue staining of the SDS-PAGE gel, the E. coli expression clones displayed a band that migrated at the expected molecular weight. The absence of this band in the control culture (without IPTG) indicated that it is specifically induced by IPTG. Western blotting with antibodies specific for flagellin confirmed that this induced species is the flagellin-RSV antigen fusion protein and indicated that both parts of the fusion protein were expressed intact. Recombinant baculoviruses induced expression of a protein band in conditioned Hi-5 cell media that reacted with His$_6$ antibody, anti-RSV monoclonal antibody and anti-flagellin antibody at the expected molecular weight for the chosen RSV F protein construct.

Protein Purification—Methods

Bacterial Growth and Cell Lysis:

STF2Δ.RSVM2 (SEQ ID NO: 626), STF2Δ.RSVG130-230 (SEQ ID NO: 622) and STF2Δ.RSVG66-298 (SEQ ID NO:624) proteins were produced in the E. coli host strain BLR (DE3). E. coli cells were cultured and harvested as described above. The individual strain was retrieved from a glycerol stock and grown in shake flasks to a final volume of 12 liters. Cells were grown in LB medium containing 50 µg/mL kanamycin, 12.5 µg/mL tetracyclinE, 0.5% dextrose to $OD_{600}$=0.6 and induced by the addition of 1 mM IPTG for 3 hours at 37° C. The cells were harvested by centrifugation (7000 rpm×7 minutes in a Sorvall RC5C centrifuge) and resuspended in 1×PBS, 1% glycerol, 1 µg/mL DNAse I, 1 mM PMSF, protease inhibitor cocktail and 1 mg/mL lysozyme. The cells were then lysed by two passes through a microfluidizer at 15,000 psi. The lysate was then centrifuged at 45,000×g for one hour to separate soluble and insoluble fractions.

Protein Purification from Recombinant E. coli:

Following lysis and centrifugation, the insoluble (pellet) fraction containing fusion proteins was resuspended and homogenized in 50 mM Tris, pH 8.0, followed by 50 mM Tris, pH 8.0 plus 0.5% (w/v) Triton X-100 using a Dounce homogenizer. The homogenate was then centrifuged (19,000 rpm×10 min). The resulting pellet fraction was then homogenized in 50 mM Tris, pH 8.0, plus 0.5% (w/v) Triton X-100+ 0.1 M NaCl and centrifuged. This material was then washed with 50 mM Tris, pH 8.0+0.1 M NaCl. The inclusion body fraction (pellet) was then dissolved in buffer A (50 mM Na Acetate, pH 4.0, plus 8.0 M urea) and centrifuged (19000 rpm×10 minutes) to remove insoluble debris. The resulting supernatant was fractionated on a Source S column (GE Healthcare; Piscataway, N.J.) equilibrated in Buffer A and eluted in a linear gradient with buffer B (50 mM Na Acetate, pH 4.0, 1.0 M NaCl). The protein was then refolded by ten-fold dilution into 100 mM Tris-HCl buffer, pH 8.0. The refolded protein was then fractionated on a Q Sepharose HP column (GE Healthcare; Piscataway, N.J.) equilibrated in Buffer C (100 mM Tris, pH 8.0) and eluted in a 0-about 60% linear gradient with buffer D (Buffer C+1M NaCl). The Q HP eluate was then fractionated on a Superdex 200 10/30 size exclusion chromatography (SEC) column (GE/Amersham Biosciences) equilibrated with 1× Tris-buffered saline, pH 8.0, to separate monomeric fusion protein from aggregated protein. Monomeric fractions were then pooled, aliquoted and stored at −80° C.

Protein Expression and Purification from Recombinant Baculovirus:

For baculovirus expression of RSV proteins, Hi-5 cells (Invitrogen; Carlsbad, Calif.) were grown to a density of about 1×10$^6$ cells/ml and infected with recombinant baculovirus at a multiplicity of infection (MOI) of about 2. After about 24 hours of infection, conditioned medium was harvested by centrifugation. Secreted RSVF.His$_6$ (SEQ ID NO: 617) and RSVF.STF2ngHis$_6$ (SEQ ID NO: 615) proteins were purified from conditioned medium by Ni-NTA affinity chromatography. Conditioned medium supplemented with 20 mM Tris, pH 8+0.5M NaCl and applied to a 250 mL Ni-NTA column (Sigma-Aldrich; St. Louis, Mo.). After washing with Equilibration buffer (20 mM Tris, pH 8+0.5M NaCl), bound protein was eluted with a 5 column-volume gradient of 0-100% Elution buffer (Equilibration Buffer+ 0.5M imidazole). Peak fractions containing RSV-F protein were pooled, dialyzed against Equilibration Buffer and applied to a 25 mL Ni-NTA column (Sigma-Aldrich; St. Louis, Mo.). After eluting in a gradient of 0-100% Elution buffer, peak fractions (as determined by SDS-PAGE and western blotting) were pooled, dialyzed against phosphate-buffered saline (PBS), aliquoted and stored.

SDS-PAGE and Western Blot Analysis:

Protein identity and purity of RSV protein antigen constructs was determined by SDS-PAGE. An aliquot of about 5 µg of each sample was diluted in SDS-PAGE sample buffer with or without 100 mM DTT as a reductant. The samples were boiled for 5 minutes, loaded onto a 10% polyacrylamide gel (LifeGels; French's Forest, New South Wales, AUS) and electrophoresed. The gel was stained with Coomassie R250 (Bio-Rad; Hercules, Calif.) to visualize protein bands. For Western blot, about 0.5 µg/lane total protein was electrophoresed as described above and the gels were then electro-transferred to a PVDF membrane and blocked with 5% (w/v) non-fat dry milk before probing with anti-flagellin antibody (Inotek; Beverly, Mass.). After probing with alkaline phosphatase-conjugated secondary antibodies (Pierce; Rockland, Ill.), protein bands were visualized with an alkaline phosphatase chromogenic substrate (Promega; Madison, Wis.).

Protein Assay:

Total protein concentration for all proteins was determined using the Micro BCA (bicinchonic acid) Assay (Pierce; Rockland, Ill.) in the microplate format, using bovine serum albumin as a standard, according to the manufacturer's instructions.

Endotoxin Assay:

Endotoxin levels for all proteins were determined using the QCL-1000 Quantitative Chromogenic LAL test kit (Cambrex; E. Rutherford, N.J.), following the manufacturer's instructions for the microplate method.

TLR Bioactivity Assay:

HEK293 cells constitutively express TLR5, and secrete several soluble factors, including IL-8, in response to TLR5 signaling. Cells were seeded in 96-well microplates (50,000 cells/well), and STF2Δ.RSVM2 (SEQ ID NO: 625), STF2Δ.RSVG130-230 (SEQ ID NO:621), STF2Δ.RSVG66-298 (SEQ ID NO: 623) or RSVF.STF2His$_6$ (SEQ ID NO: 615), was added and incubated overnight. The next day, the conditioned medium was harvested, transferred to a clean 96-well microplate and frozen at −20° C. After thawing, the conditioned medium was assayed for the presence of IL-8 in a sandwich ELISA using an anti-human IL-8 matched antibody pair (Pierce; Rockland, Ill.) #M801E and M802B) following the manufacturer's instructions. Optical density was measured using a microplate spectrophotometer (FARCyte, GE Healthcare; Piscataway, N.J.).

Protein Purification—Results

Protein Yield and Purity:

STF2Δ.RSVM2 (SEQ ID NO: 625), STF2Δ.RSVG130-230 (SEQ ID NO: 621) and STF2Δ.RSVG66-298 (SEQ ID NO: 623) were produced in high yield from E. coli cell culture. Total yields following purification ranged from about 5 to about 15 mg, the purity of all three proteins exceeded about 90% by SDS-PAGE, and the endotoxin values for each protein was less than 0.05 EU/μg. All three STF2Δ.RSV fusion proteins produced in E. coli fusion proteins showed positive in vitro TLR5 bioactivity.

RSVF.STF2His$_6$ (SEQ ID NO: 615) and RSVF.His$_6$ (SEQ ID NO: 617) were expressed by recombinant baculovirus in Hi-5 cell conditioned medium and partially purified in total yields ranging from about 1 to about 2 mg. RSVF.STF2His$_6$ (SEQ ID NO: 615) had positive in vitro TLR5 activity and both proteins had undetectable levels of endotoxin.

Immunogenicity Testing—Methods

Animal Studies:

Female Balb/c mice (Jackson Laboratory, Bar Harbor, Me.) were used at the age of 6-8 weeks. Test proteins were formulated in about 100 μl of phosphate-buffered saline per injection. Mice were divided into groups of 10 and received inguinal subcutaneous (s.c.) immunizations as follows:

Immunogenicity Study #1:

Primary immunization: Day 0; Boost: Day 28
  group
    1. PBS (Phosphate-buffered saline; negative control)
    2. 3 μg of STF2Δ.RSVM2 (SEQ ID NO: 625)

Two (2) mice/group were sacrificed by CO$_2$ inhalation 7 days post-prime and 7 days post boost. Spleen cells were harvested and analyzed for RSVM2-specific T-cell responses by ELISPOT assay, as described below.

Immunogenicity Study #2:

Primary immunization: Day 0; Boost: Day 14
  group
    1. PBS (Phosphate-buffered saline; negative control)
    2. 3 μg of STF2Δ.RSVG130-230 (SEQ ID NO: 621)
    3. 3 μg of STF2Δ.RSVG66-298 (SEQ ID NO: 623)

Mice were bled by retro-orbital puncture on day 21. Sera were harvested by clotting and centrifugation of the heparin-free blood samples, and tested by ELISA for RSV-specific IgG antibody responses as described below.

Immunogenicity Study #3:

Primary immunization: Day 0; Boost: Day 21
  group
    1. PBS (Phosphate-buffered saline; negative control)
    2. 100 μl of RSVF.STF2His$_6$ (SEQ ID NO: 615)
    3. 10 μl of RSVF.STF2His$_6$ (SEQ ID NO: 615)
    4. 50 μl of RSVF.STF2His$_6$ (SEQ ID NO: 615) formulated in TiterMax Gold adjuvant (CytRx; Norcross, Ga.), according to the manufacturer's instructions.

Mice were bled by retro-orbital puncture on day 28. Sera were harvested by clotting and centrifugation of the heparin-free blood samples, and tested by ELISA for RSV-specific antibody responses as described below.

RSV Serum Antibody Determination:

RSV G and F protein-specific IgG levels were determined by ELISA. ELISA plates (96 wells) were coated overnight at 4° C. with 100 ml/well of either RSVG peptide NH$_2$-HPE-VFNFVPCSICSNNPTCWAICKRI-COOH (SEQ ID NO: 627), RSVF.His$_6$ protein (SEQ ID NO: 617) or RSV A2 virus in PBS at a concentration of 2 μg/ml. Plates were blocked with 200 μl/well of Assay Diluent Buffer (ADB; BD Pharmingen, San Diego, Calif.) for on hour at room temperature. The plates were washed 3× in PBS-T. Dilutions of the sera in ADB were added (100 μl/well) and the plates were incubated overnight at 4° C. The plates were then washed 3× with PBS-T. HRP-labeled goat anti-mouse antibody (Jackson Immunochemical; West Grove, Pa.) diluted in ADB was added (100 μl/well) and the plates were incubated at room temperature for 1 hour. The plates were washed 3× with PBS-T. After adding TMB (3,3',5,5'-tetramethylbenzidine) Ultra substrate (Pierce Biotechnology; Rockford, Ill.) and monitoring color development, absorbance at 450 nm ($A_{450}$) was measured on a Tecan Farcyte microspectrophotometer.

RSVM2 Antigen-Specific ELISPOT Assays:

Spleen cells ($10^6$ cells/well) from animals 7 days following primary immunization or 7 days following the booster immunization with of STF2Δ.RSVM2 (SEQ ID NO: 625) were added to 96-well Multiscreen-IP plates (Millipore; Billerica, Mass.) coated with anti-IFNγ or IL-5 capture antibody (eBioscience; San Diego, Calif.) diluted in PBS according to the manufacturer's instructions. T cells were then stimulated overnight with naïve antigen-presenting cells (APCs) ($10^6$ cells/well) in the absence or presence of a pool of overlapping 15-mer peptides spanning the RSV M2 protein (AnaSpec; San Jose, Calif.). Anti-CD3 (BD Pharmingen; San Jose, Calif.) was used as a positive control at a final concentration of 0.25 μg/ml. Plates were incubated overnight at 37° C./5% $CO_2$, then washed and incubated with biotinylated detection antibody diluted in PBS/10% fetal bovine serum (FBS) according to the manufacturer's instructions. Plates were developed using the ELISPOT Blue Color Development Module according to the manufacturer's protocol (R&D Systems; Minneapolis, Minn.). Antigen-specific responses were assayed in duplicate from individual animals and quantified using an automated ELISPOT reader (Cellular Technology Ltd.; Cleveland, Ohio). Data is represented as the number of antigen-specific responses/$10^6$ APC.

Growth of RSV Virus Strain A2:

RS virus was produced for use in direct ELISA assay to determine immune serum reactivity with the native virion. HEp-2 monolayers were infected with RSV A2. When approximately 75% of the cells demonstrated cytopathic effects (CPE), the monolayers were scraped, pelleted, and washed once in PBS. The pellets were then resuspended in 0.5% NP-40 in water, 1 ml per 100 mm dish, and then incubated on ice for about 10 minutes. The cell lysates were centrifuged at 10 k rpm at 4° C. to pellet cell nuclei. The supernatants were pooled, aliquoted, and stored at −20° C. The lysate was used to coat ELISA plates which were subsequently probed with mouse immune sera.

RSV Whole-Cell ELISA:

Vero cells (ATCC; Manassas, Va.) were grown to near confluence in 96-well transparent tissue culture plates. Half of each plate was infected overnight with RSV A2 virus. The monolayers were fixed with formalin and then blocked with assay diluent (BD Biosciences). Titrations of individual sera were added to the fixed monolayers and incubated overnight. The following day, HRP goat-anti mouse IgG was added to detect bound antibodies. The plates were developed using TMB Ultra substrate (Pierce; Rockland, Ill.) and Abs 450 nm ($A_{450}$) was measured. The background absorbance from uninfected wells was subtracted from the absorbance from corresponding infected wells and plotted.

RSV Serum Neutralization Assay:

About 1000 pfu/well of RSV strain A2 was pipetted into 96-well tissue culture plates. Serial dilutions of mouse immune sera were added. After a about a 60 minute incubation at about 37° C., Vero cells were added and the plates were cultured for 7 days. Infectivity and neutralization were assessed via the Cytotox One™ cellular cytotoxicity assay (Promega; Madison, Wis.) according to the manufacturers instructions. Results were plotted as percent neutralization.

Immunogenicity Testing—Results

Figure 42A:
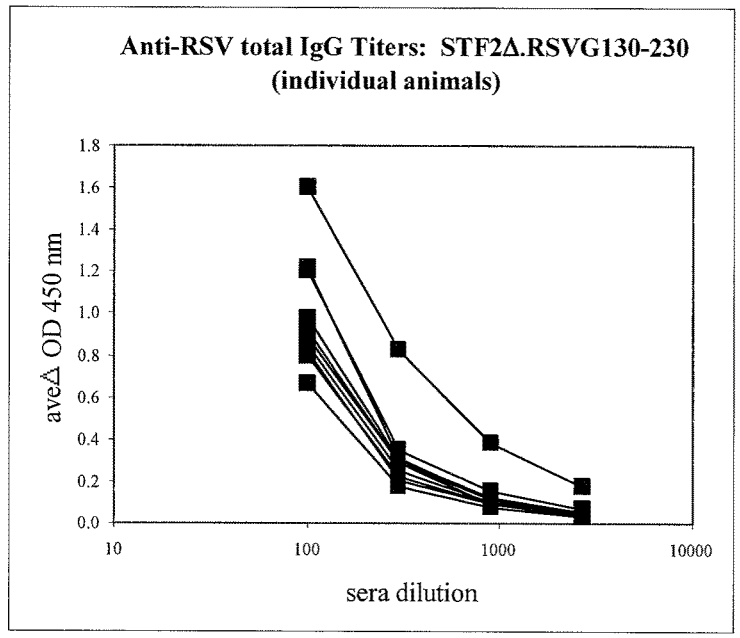
FIGS. 42A-42C depict the IgG antibody response to STF2Δ.RSVG fusion proteins in Immunogenicity Study #2.
Figure 42B:
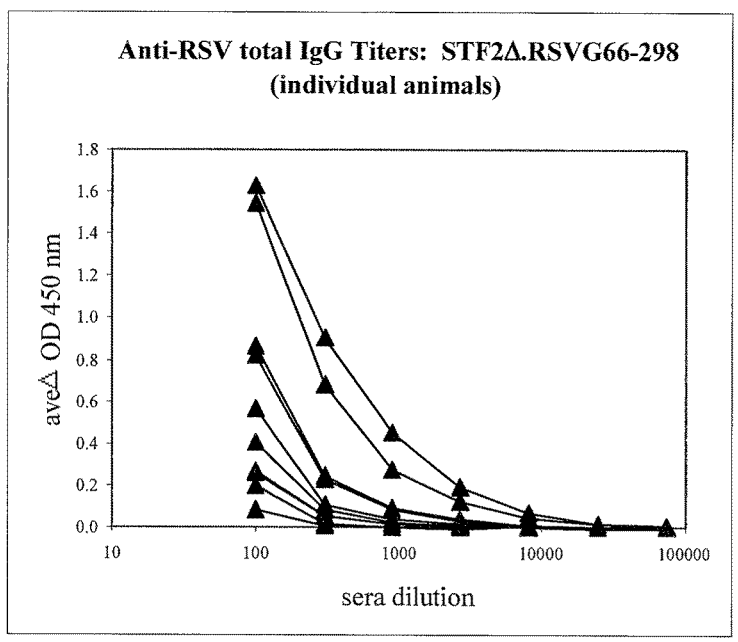
Figure 42C:
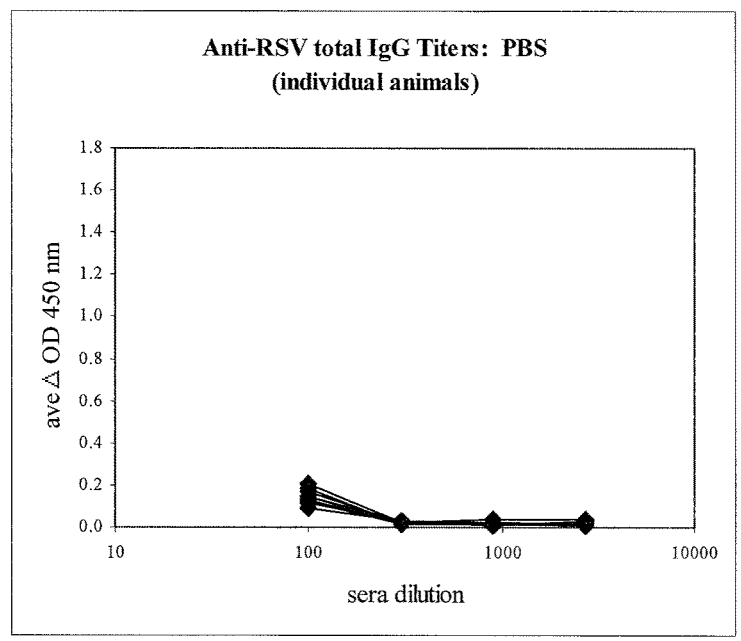
Figure 43A:
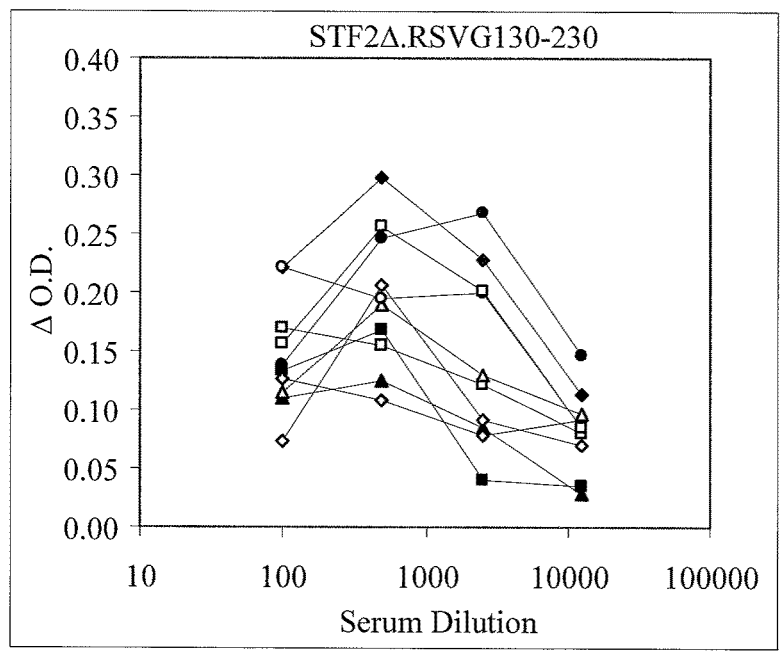
FIGS. 43A-43B depict the IgG antibody response to STF2Δ.RSVG fusion proteins in Study #2 using the whole-cell RSV ELISA assay FIG. 43A—Mice immunized with STF2Δ.RSVG130-230 (SEQ ID NO: 621) FIG. 43B—Mice immunized with STF2Δ.RSVG66-298 (SEQ ID NO: 571).
Figure 43B:
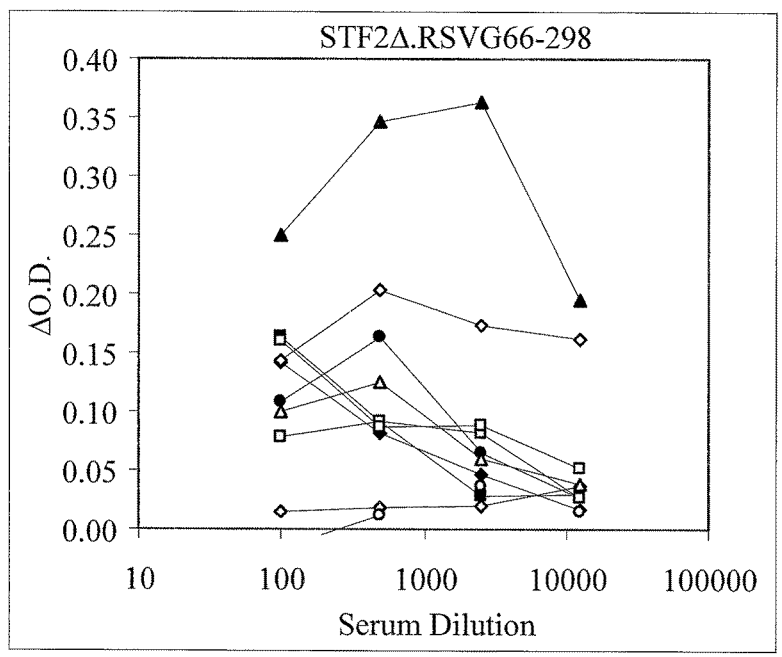

RSVG- and RSVF-Specific Antibody Responses:

As shown in FIGS. 42A-42C, immunization of mice with STF2Δ.RSVG130-230 protein (SEQ ID NO: 621) or STF2Δ.RSVG66-298 (SEQ ID NO: 624) elicited the production of serum IgG specific for which reacted with the highly conserved RSVG peptide, $NH_2$-HPEVFNFVPCSICSN-NPTCWAICKRI-COOH (SEQ ID NO: 627), while control sera did not. The immune sera also specifically recognized RSV A2 infected Vero cells in the whole-cell ELISA assay (FIGS. 43A and 43B), demonstrating that immunization with either of these vaccine constructs elicits antibodies which recognize the native RS virus. Immunization with RSVF.STF2His$_6$ (SEQ ID NO: 616) also elicited RSV-specific antibodies. As shown in FIG. 44A, immune sera from mice immunized with 10 μl or 100 μl of RSVFng.STF2His$_6$ specifically reacted with recombinant RSVF.His$_6$ protein. Notably, as shown in FIG. 44B, these sera also recognized the RS A2 virus in the whole-virus ELISA format, demonstrating that immunization with RSVF.STF2His$_6$ (SEQ ID NO: 616) elicts antibodies which recognize the native virus. Administration of the RSVF.STF2His$_6$ (SEQ ID NO: 615) protein formulated in TiterMax™, a powerful adjuvant which is not acceptable for human use, did not significantly enhance the RSV-specific antibody response.

Figure 45:
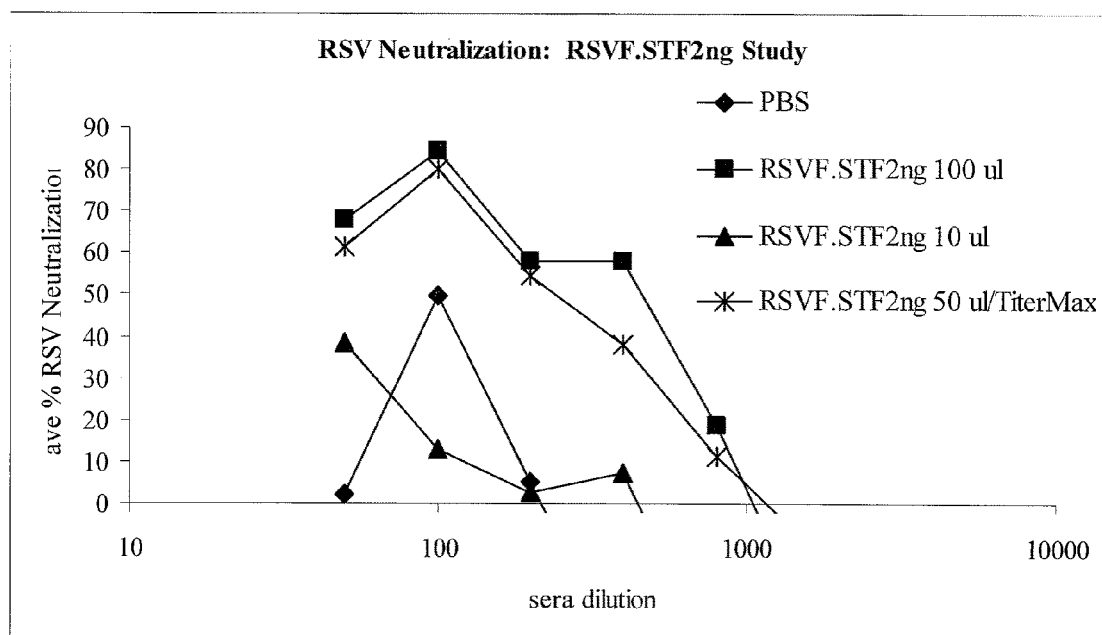
FIG. 45 depicts immunogenicity of RSVF.STF2His6 (SEQ ID NO: 615) in an RSV virus neutralization assay.

Any effective vaccine for respiratory syncytial virus (RSV) must induce a neutralizing antibody response. Antibodies produced by immunization with RSVF.STF2His$_6$ (SEQ ID NO: 615) are capable of neutralizing RS virus infectivity in vitro. As shown in FIG. 45 neutralization by immune sera from Group 2 (about a 100 μl dose, estimated to be less than about 1 μg of RSVF.STF2His$_6$ (SEQ ID NO: 615) protein, is half-maximal at a serum dilution of about 1:500. The one-tenth of this dose (Group 3) also elicits detectable neutralization activity in the immune sera. Finally, as with the RSV-specific IgG response (described above), administration of about 50 μl of RSVF.STF2His$_6$ (SEQ ID NO: 615) protein formulated in the potent adjuvant TiterMax Gold™ elicits a neutralizing response very similar in magnitude to the 100 ml dose formulated only in physiological buffer.

Figure 46A:
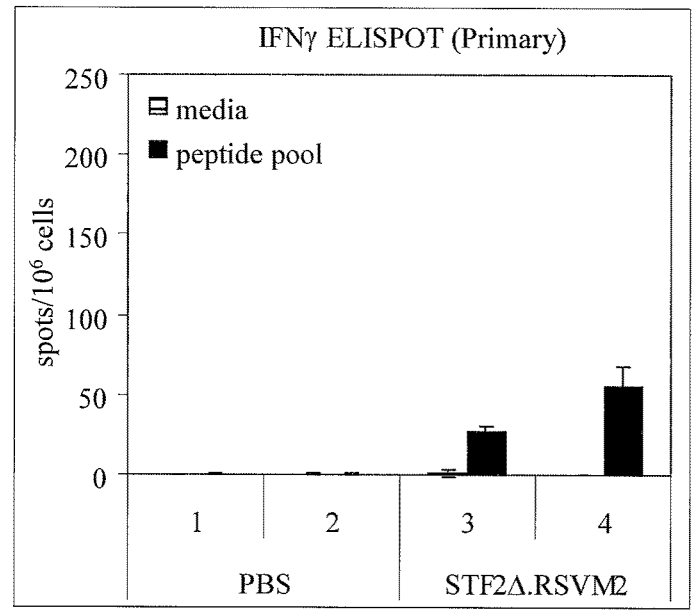
FIGS. 46A-46D depict T-cell responses induced by STF2Δ.RSVM2 (SEQ ID NO: 625) in Immunogenicity Study #1 as determined by ELISPOT assay.
Figure 46B:
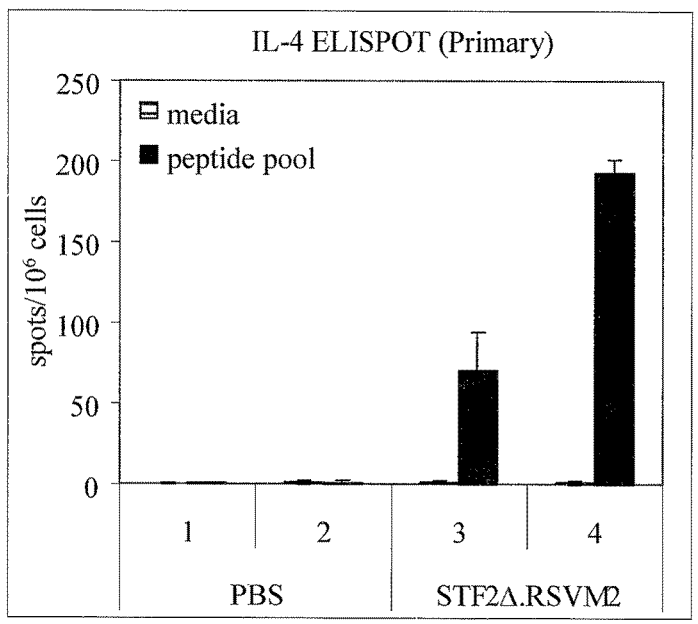
Figure 46C:
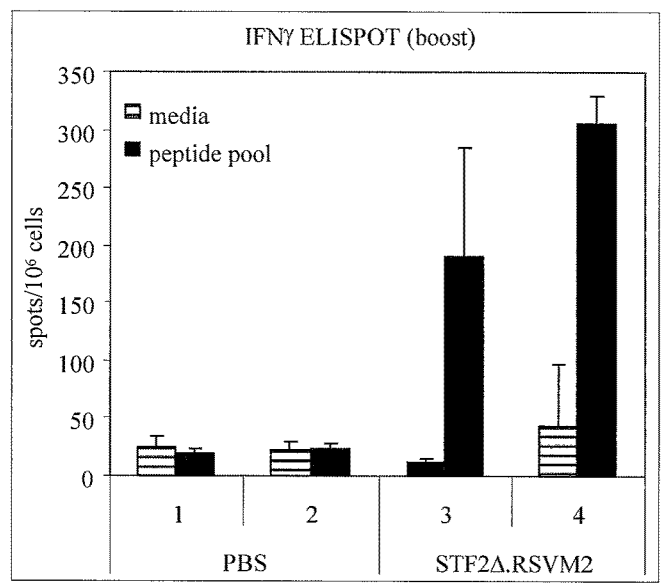
Figure 46D:
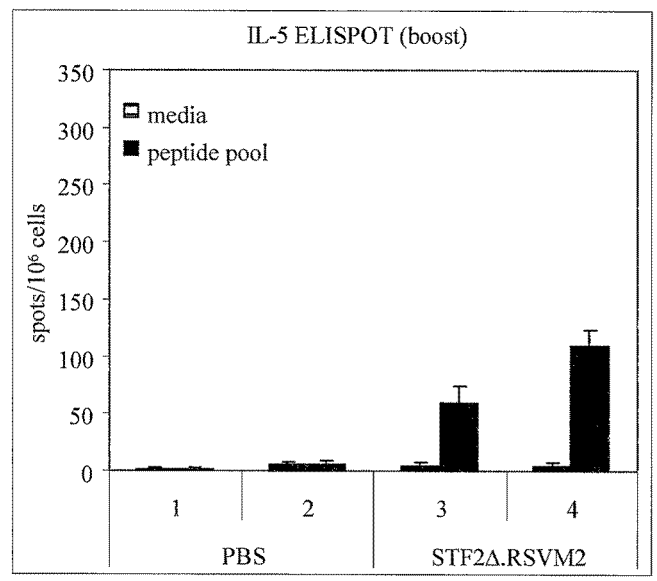
Figure 47A:
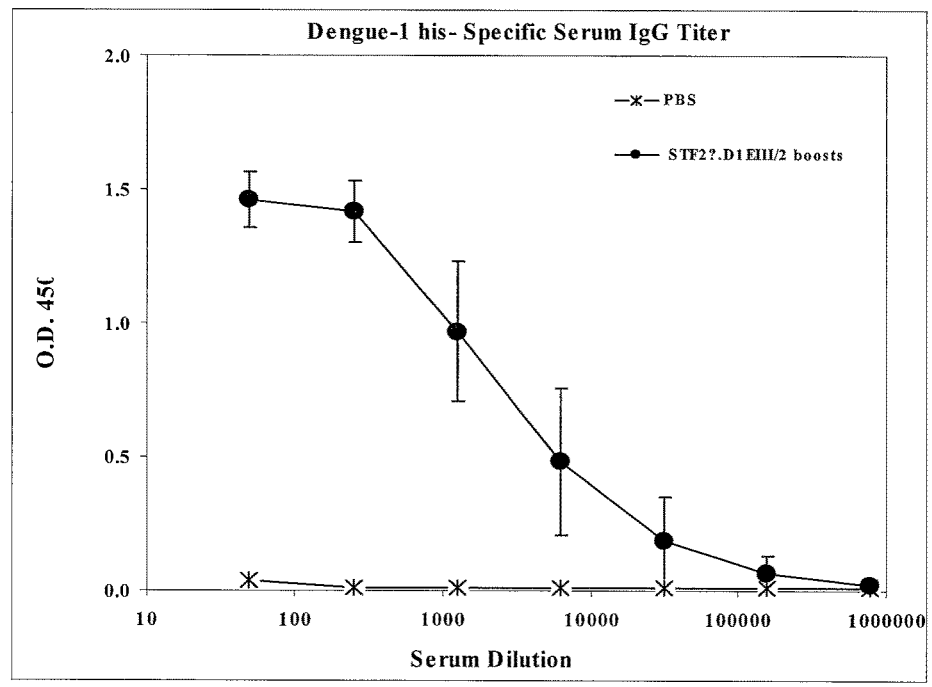
FIGS. 47A through 47D depict serum IgG responses elicited in mice following immunization with STF2Δ.DEN(1-4) EIII+ proteins (SEQ ID NO: 628); (SEQ ID NO: 630); (SEQ ID NO: 632) and (SEQ ID NO: 634) as determined by ELISA using DEN 80% EHisBv proteins (SEQ ID NO: 636); (SEQ ID NO: 638); (SEQ ID NO: 640) and (SEQ ID NO: 642).
Figure 47B:
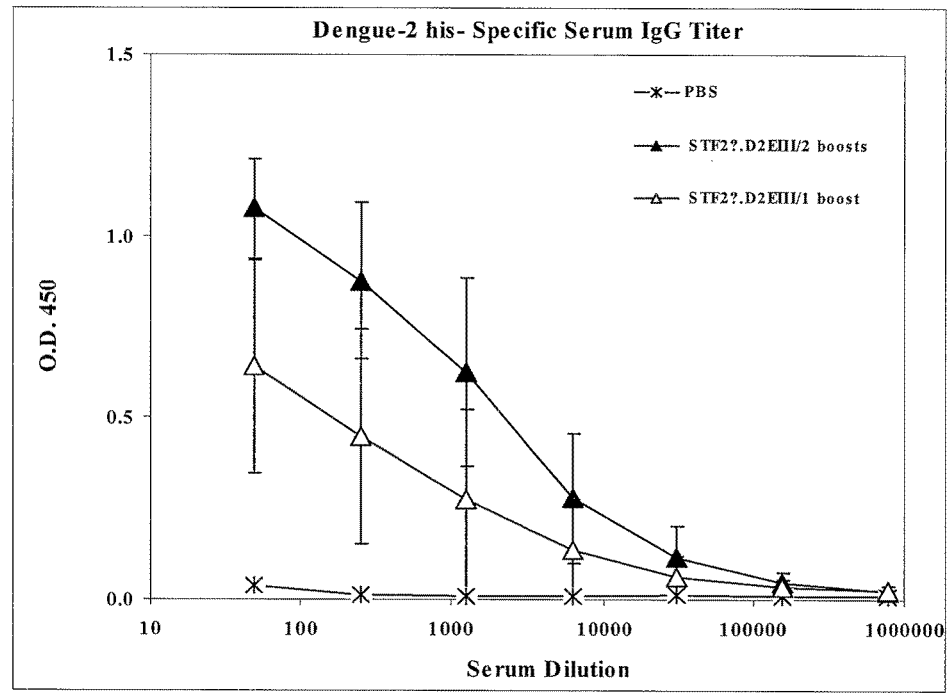
Figure 47C:
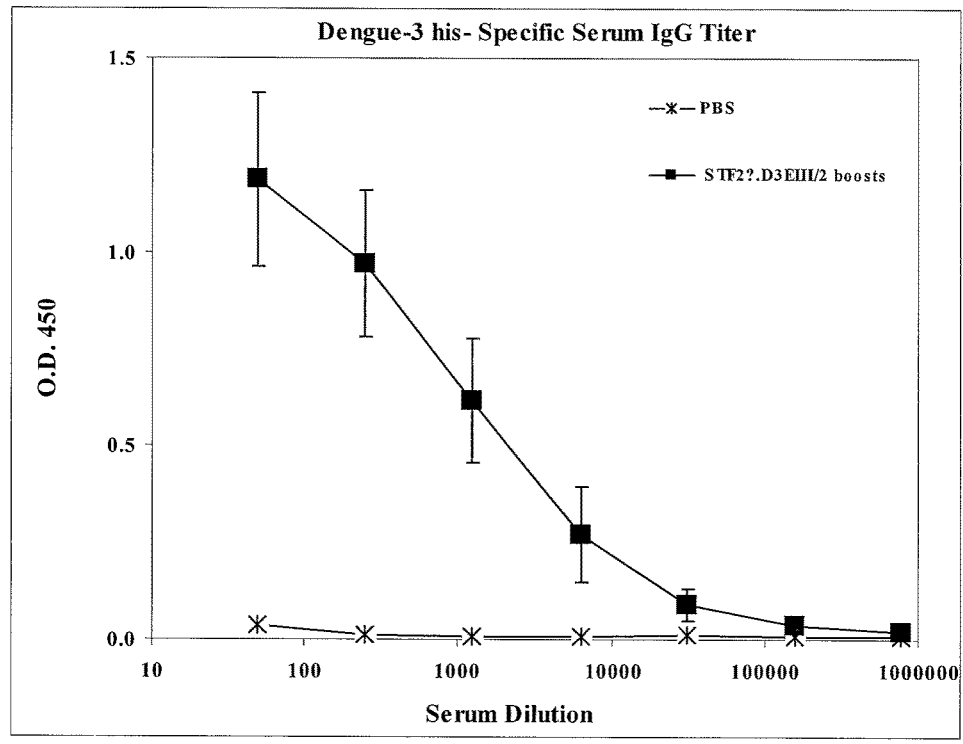
Figure 47D:
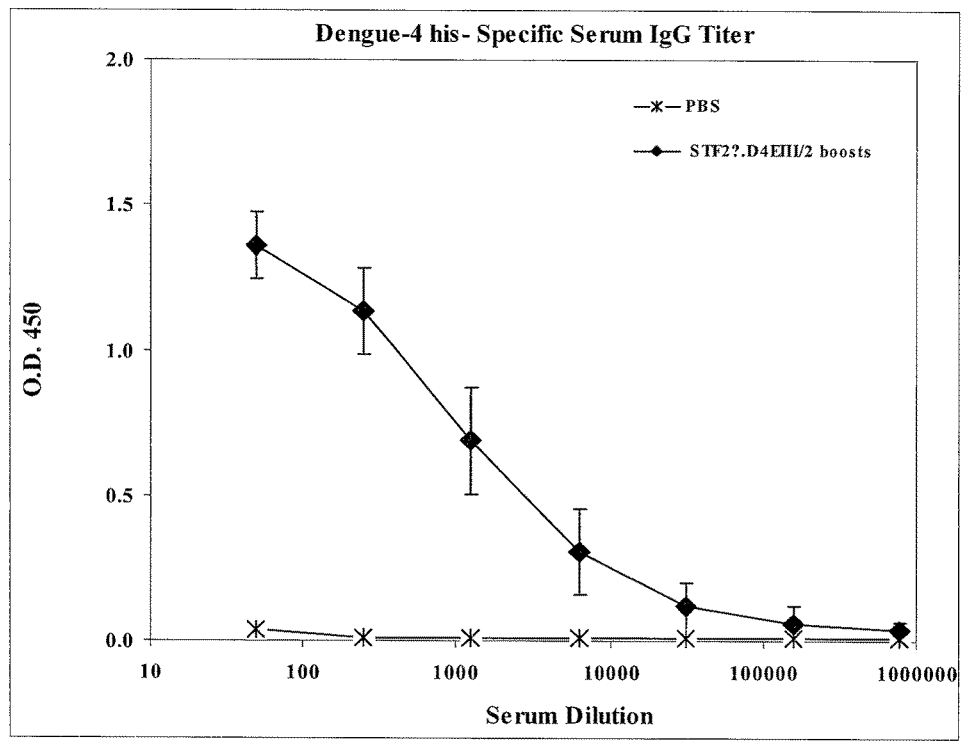
Figure 48A:
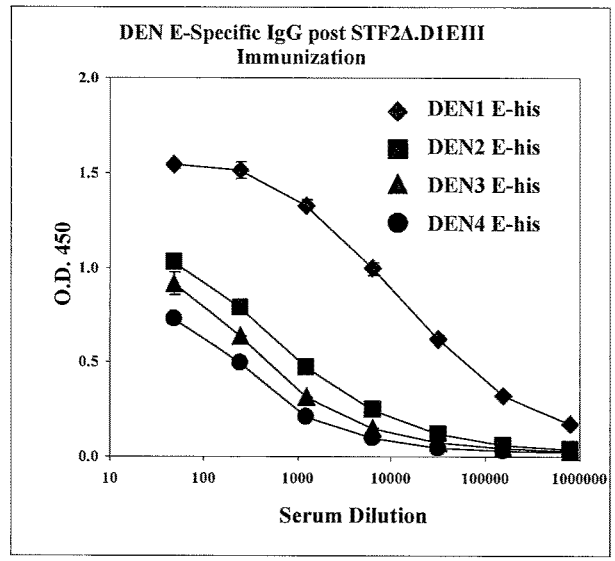
FIGS. 48A through 48D depict immune serum IgG cross-reactivity with heterologous DEN 80% EHisBv proteins as determined by ELISA.
Figure 48B:
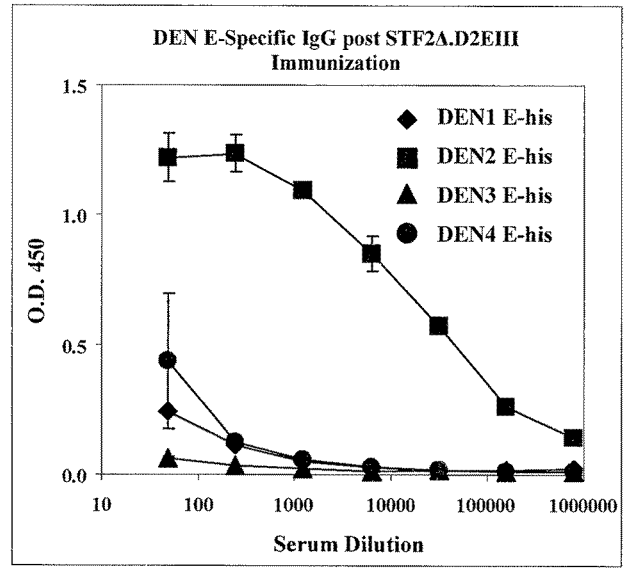
Figure 48C:
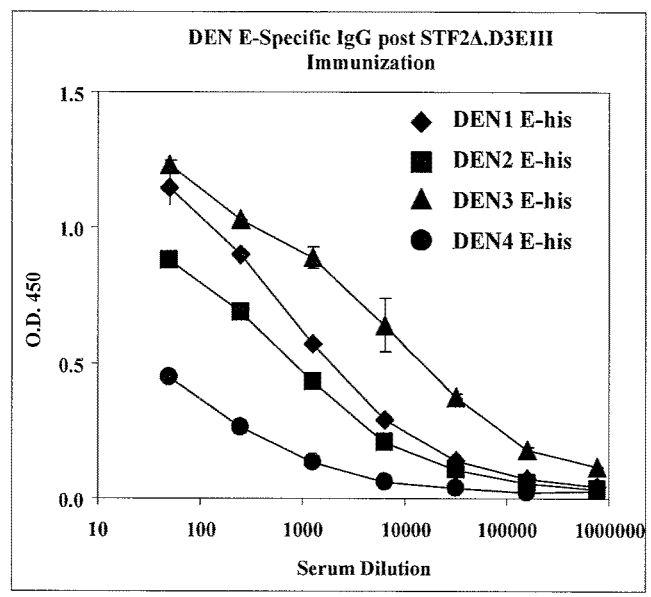
Figure 48D:
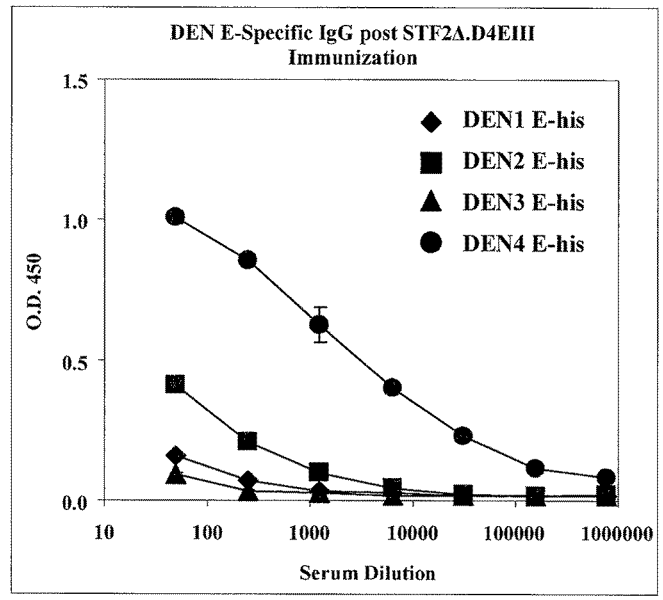
Figure 49A:
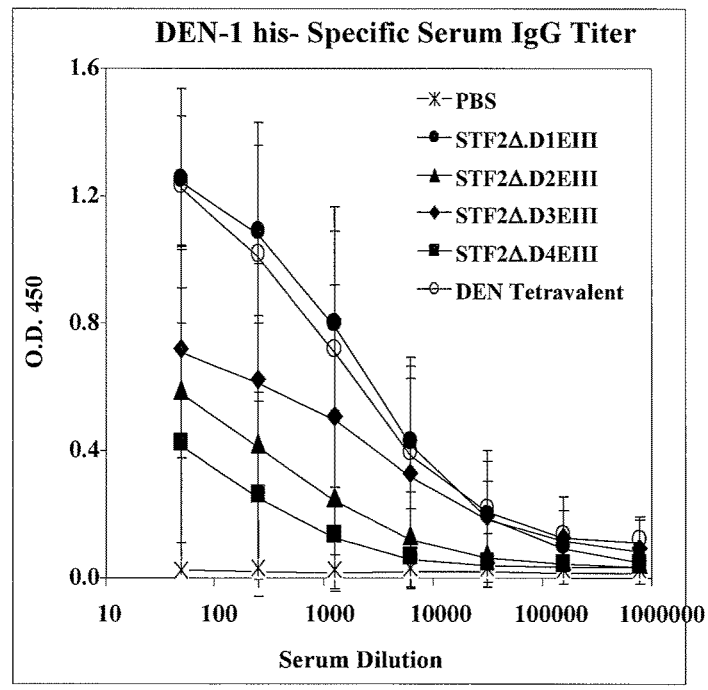
FIGS. 49A, 49B, 50A and 50B depict serum IgG responses elicited in mice following immunization with STF2Δ.DEN (1-4)EIII+ proteins (SEQ ID NO: 628); (SEQ ID NO: 630); (SEQ ID NO: 632) and (SEQ ID NO: 634) individually (monovalent formulation) or combined in a tetravalent formulation. As determined by ELISA using DEN 80% EHisBv proteins (SEQ ID NO: 636); (SEQ ID NO: 638); (SEQ ID NO: 640) and (SEQ ID NO: 642).
Figure 49B:
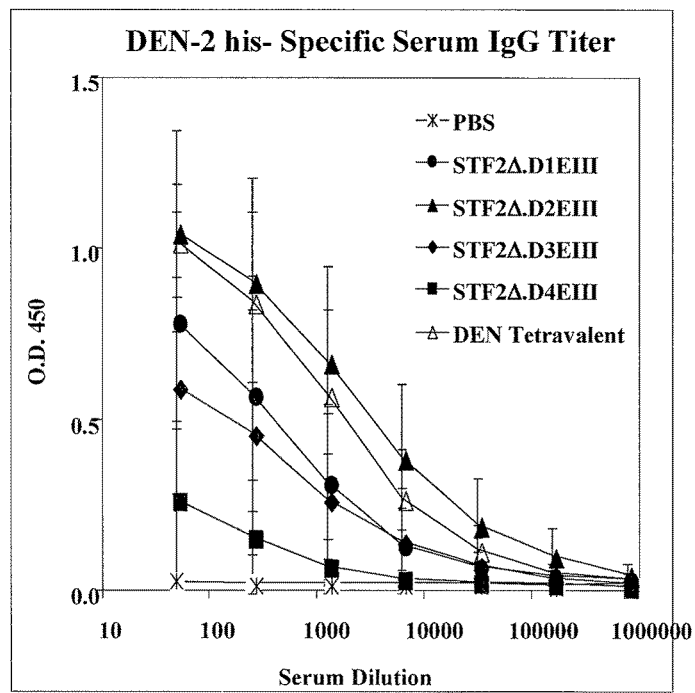
Figure 50A:
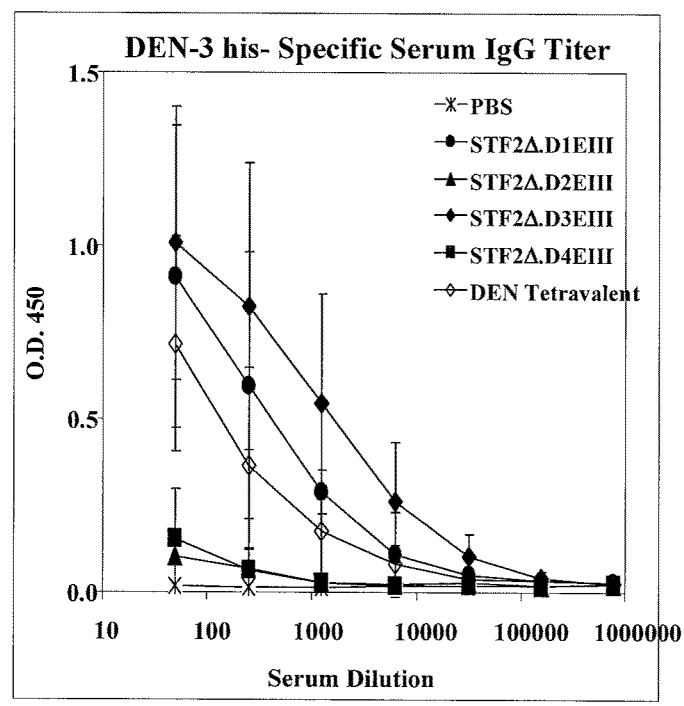
Figure 50B:
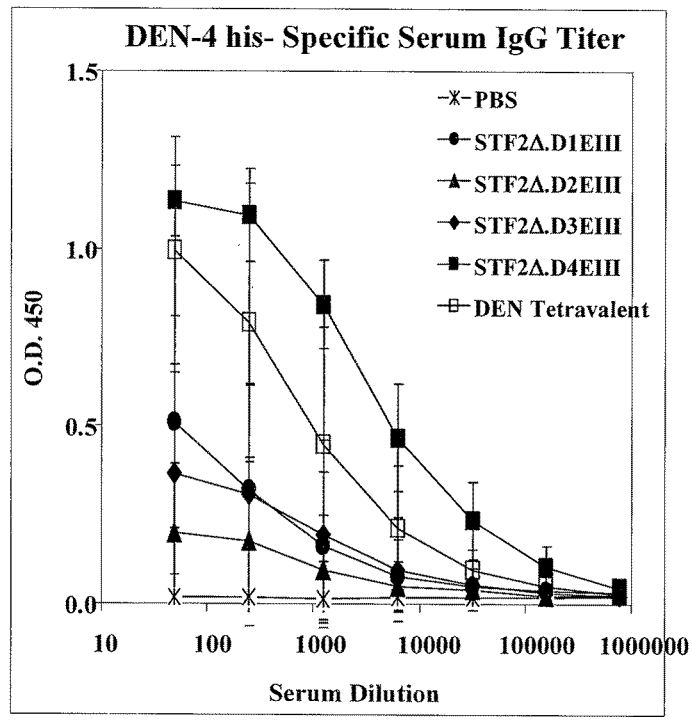
Figure 52A:
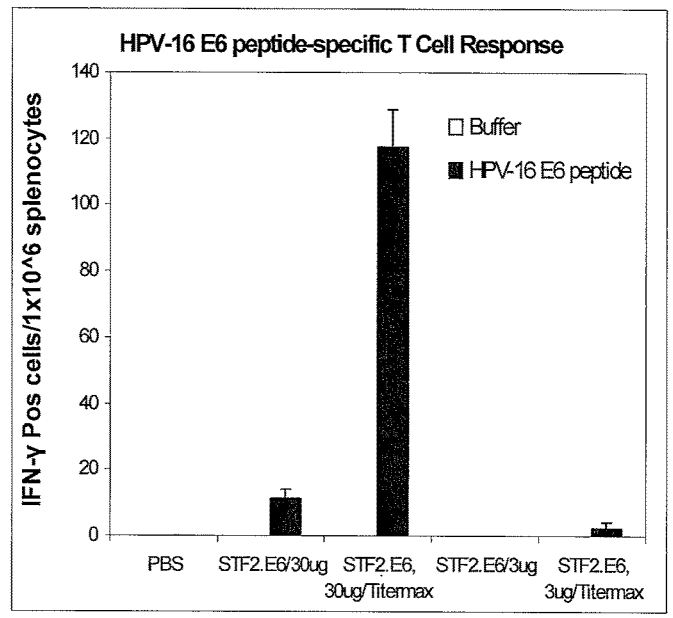
FIGS. 52A and 52B depict HPV16 E6 antigen-specific T cell responses in mice following a single immunization with STF2.HPV16 E6 (SEQ ID NO: 679) by ELISPOT assay of IFN-γ-positive cells (FIG. 52A) and IL-5-positive cells (FIG. 52B).
Figure 52B:
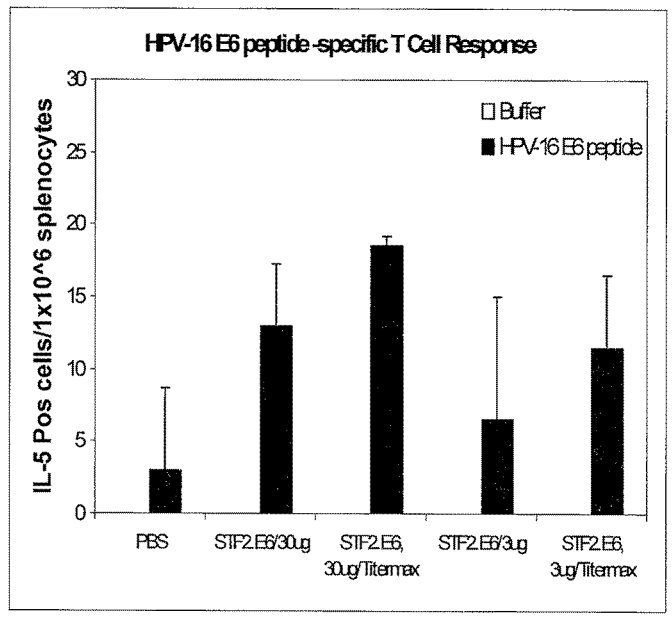
Figure 53A:
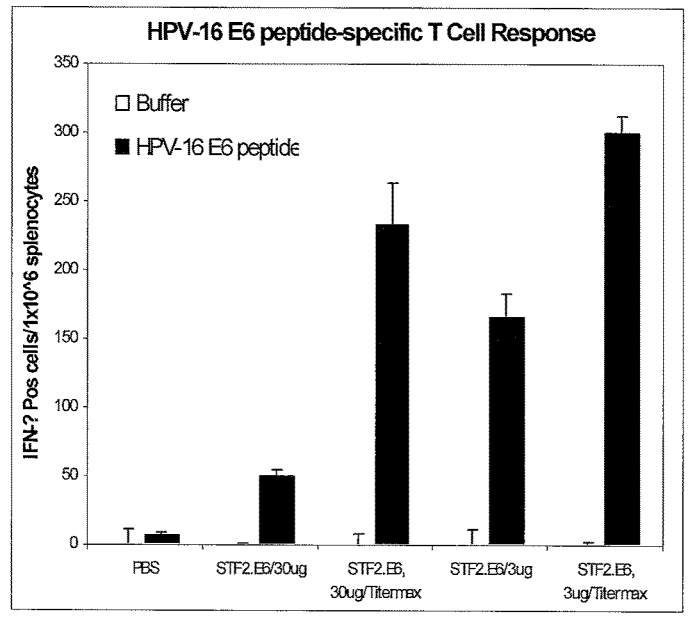
FIGS. 53A and 53B depict HPV16 E6 antigen-specific T cell responses in mice following two immunizations with STF2.HPV16 E6 (SEQ ID NO: 679) by ELISPOT assay of IFN-γ-positive cells (FIG. 52A) and IL-5-positive cells (FIG. 52B).
Figure 53B:
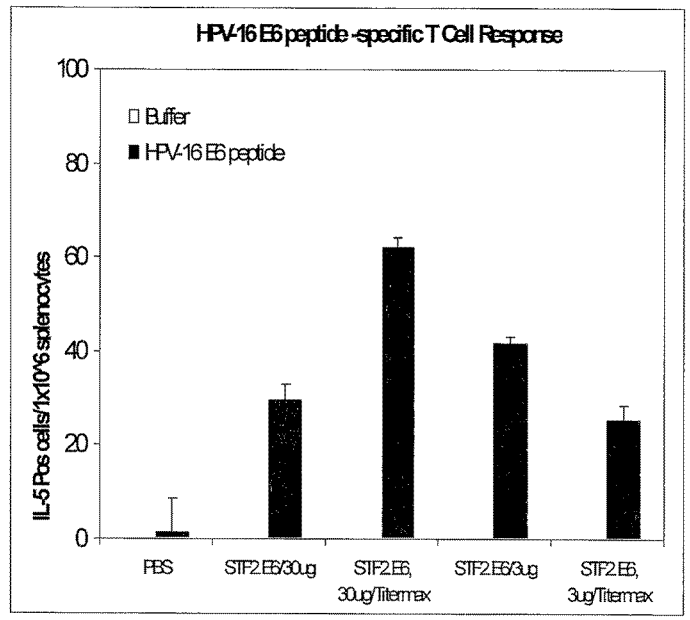

RSVM2-Specific T-Cell Responses:

The results of the ELISPOT assay shown in FIGS. 46A and 46B indicate that mice developed antigen-specific T cell responses following a single immunization with STF2.RSVM2 (SEQ ID NO: 625) and that mock-immunized mice did not. Upon stimulation with antigen presenting cells (APCs) primed with the RSVM2 peptide pool, about 25 to about 50 cells/$10^6$ splenocytes secreted IFN-γ compared to none in the mock immunized group. More cells from animals immunized with STF2.RSVM2 (SEQ ID NO: 625), secreted IL-5, ranging from about 75 to about 200 cells/$10^6$ splenocytes. Naïve APCs mock-primed with buffer did not stimulate production of IFN-γ or IL-5 in any of the groups.

ELISPOT assays performed on spleen cells harvested 7 days following the booster immunization with STF2.RSVM2 (SEQ ID NO: 625) showed a significant increase in RSVM2 antigen-specific T-cells secreting IFNγ as compared cells harvested following the primary immunization. Upon stimulation with antigen presenting cells (APCs) primed with the RSVM2 peptide pool, between about 150 and about 300 cells/$10^6$ splenocytes secreted IFN-γ. The number of cells secreting IL-5 following the boost was about 50 to about 100 cells/$10^6$ splenocytes. The relative increase in the production of IFN-γ between the prime and boost is indicative of shift from a Th2-dominated immune response to a Th-1 dominated response and suggests the induction of an effector T-cell response against the target antigen.

Example 11

DNA Cloning and Protein Expression—Methods

DNA Cloning and Protein Expression in *E. coli*:

Synthetic genes encoding 112 amino acids encompassing Domain III (EIII), and including amino acids from Domain I (EI), of the envelope (E) protein from Dengue virus serotypes Den1, Den2, Den3 and Den4 (SEQ ID NO: 652; SEQ ID NO: 654; SEQ ID NO: 656; SEQ ID NO: 658, respectively) were codon optimized for expression in *E. coli* and synthesized by a commercial vendor (DNA 2.0; Menlo Park, Calif.). The genes were designed to incorporate flanking BlpI sites on both the 5' and 3' ends. The gene fragments were excised from the respective plasmids with BlpI and cloned by compatible ends into the STF2Δ.blp vector cassette with a 12 amino acid linker between the EIII and STF2Δ domains. The DNA constructs were designated STF2Δ.DEN1EIII+ (SEQ ID NO: 629), STF2Δ.DEN2EIII+ (SEQ ID NO: 631), STF2Δ.DEN3EIII+ (SEQ ID NO: 633) and STF2Δ.DEN4EIII+ (SEQ ID NO: 635).

The constructed plasmids were used to transform competent *E. coli* TOP 10 cells and putative recombinants were identified by PCR screening and restriction mapping analysis. The integrity of the constructs was verified by DNA sequencing, constructs were used to transform the expression host, BLR (DE3) (Novagen, San Diego, Calif.; Cat #69053). Transformants were selected on plates containing kanamycin (50 μg/mL), tetracycline (5 μg/mL) and glucose (0.5%). Colonies were picked and inoculated into 2 mL of LB medium supplemented with 25 μg/mL kanamycin, 12.5 μg/mL tetracycline and 0.5% glucose and grown overnight. Aliquots of these cultures were used to innoculate fresh cultures in the same medium formulation, which were cultured until an optical density ($OD_{600\,nm}$)=0.6 was reached, at which time protein expression was induced by the addition of 1 mM IPTG and cultured for 3 hours at 37° C. The cells were then harvested and analyzed for protein expression.

DNA Cloning and Protein Expression in *Baculovirus*:

The full-length envelope (E) protein of each Dengue virus Den1, Den2, Den3 and Den 4 consists of a 495 amino acid polypeptide and includes an about a 50 amino-acid C-terminal portion containing two (2) transmembrane sequences (see SEQ ID NOs: 652, 653, 654, 655, 656, 657 and 658). In order to produce soluble, recombinant E proteins for use as ELISA assay reagents, the N-terminal 400 amino acids of the envelope (E) protein from each Dengue virus 1-4 (Den1, Den2, Den3 and Den4) was cloned and expressed in baculovirus for use as ELISA assay reagents. The term "80% E", as used herein in reference to the Dengue protein sequence described herein, means the sequence lacks the two (2) C-terminal transmembrane domains and about 45 amino acids of the ectodomain. Synthetic genes encoding the 80% E sequences of the Dengue E proteins described herein were codon optimized for expression in baculovirus and synthesized by a commercial vendor (DNA 2.0; Menlo Park, Calif.) to produce SEQ ID NO: 637; SEQ ID NO: 639; SEQ ID NO: 641 and SEQ ID NO: 643. The 80% E genes were designed to include a 6×His tag on the 5' end and flanking BlpI sites on both the 5' and 3' ends.

The gene fragments were excised from the respective plasmids with BlpI and cloned by compatible ends into the pFastBac vector plasmid (Invitrogen; Carlsbad, Calif.) 3' of a honeybee mellitin secretion signal to direct secretion of the recombinant protein into the medium. The baculovirus DNA expression constructs incorporating the DEN 80% E gene were designated DEN1EHisBv (SEQ ID NO:637), DEN2EHisBv (SEQ ID NO:639), DEN3EHisBv (SEQ ID NO: 641) and DEN4EHisBv (SEQ ID NO: 643).

The constructed plasmids were used to transform competent *E. coli* TOP 10 cells and putative recombinants were identified by PCR screening and restriction mapping analysis. The integrity of the constructs was verified by DNA sequencing, and plasmid DNA was used to transform the baculovirus recombination host, DH10Bac (Invitorgen; Carlsbad, Calif.). Recombinant bacmid transformants were selected by blue-white screening on plates containing X-gal. Colonies were picked and recombination was confirmed by PCR screening. Recombinant bacmid DNA was obtained by midi-prep and used to transfect Sf9 insect cells (Invitrogen; Carlsbad, Calif.). Following titer determination by plaque assays, recombinant baculoviruses were amplified by re-infecting Sf9 cells and the titers determined by plaque assay.

For baculovirus expression of DEN proteins, Hi-5 cells (Invitrogen; Carlsbad, Calif.) were grown to a density of $1\times10^6$ cells/ml and infected with recombinant baculovirus at a multiplicity of infection (MOI) of 2. After 24 hours of infection, conditioned medium was harvested by centrifugation. Secreted DEN 80% E protein was purified from conditioned medium by Ni-NTA chromatography.

SDS-PAGE and Western Blot:

Protein expression and Dendue virus type were determined by gel electrophoresis and immunoblot analysis. Cells were harvested by centrifugation and lysed in Laemmli buffer. An aliquot of 10 μl of each lysate was diluted in SDS-PAGE sample buffer with or without 100 mM dithiothreitol (DTT) as a reductant. The samples were boiled for about 5 minutes and loaded onto a 10% SDS polyacrylamide gel and electrophoresed by SDS-PAGE. The gel was stained with Coomassie R-250 (Bio-Rad; Hercules, Calif.) to visualize protein bands. For Western Blot, 0.5 ml/lane of cell lysate was electrophoresed and electrotransfered onto a PVDF membrane and blocked with 5% (w/v) dry milk.

For flagellin fusion proteins expressed in *E. coli*, the membrane was probed with anti-flagellin antibody (Inotek; Beverly, Mass.). After probing with alkaline phosphatase-conjugated secondary antibody (Pierce; Rockland, Ill.), protein bands were visualized with an alkaline phosphatase chromogenic substrate (Promega, Madison, Wis.). Bacterial clones which yielded protein bands of the correct molecular weight and reactive with the appropriate antibodies were selected for production of protein for use in biological assays and animal immunogenicity experiments. For DEN 80% E proteins expressed in baculovirus, the membrane was probed with alkaline-phosphatase-linked anti-$His_6$ (C-terminal) antibody (Invitrogen; Carlsbad, Calif.).

DNA and protein constructs linking flagellin with Dengue antigens are listed in Table 23.

TABLE 23

Flagellin - Dengue antigen DNA constructs for expression in *E. coli* and baculovirus

| Amino acid SEQ ID NO | Nucleotide SEQ ID NO: | Construct Name | Protein predicted molecular weight (Da) |
|---|---|---|---|
| 628 | 629 | STF2Δ.DEN1EIII+ | 43,223 |
| 630 | 631 | STF2Δ.DEN2EIII+ | 43,549 |
| 632 | 633 | STF2Δ.DEN3EIII+ | 43,349 |
| 634 | 635 | STF2Δ.DEN4EIII+ | 43,274 |
| 636 | 637 | DEN1 80% $EHis_6Bv$ | 44,581 |
| 638 | 639 | DEN2 80% $EHis_6Bv$ | 45,172 |
| 640 | 641 | DEN3 80% $EHis_6Bv$ | 44,477 |
| 642 | 643 | DEN4 80% $EHis_6Bv$ | 44,603 |

DNA Cloning—Results

As assayed by Coomassie blue staining of the SDS-PAGE gel, all of the *E. coli* expression clones displayed a band that migrated at the expected molecular weight. The absence of this band in the control culture (without IPTG) indicated that it is specifically induced by IPTG. Western blotting with antibodies specific for flagellin confirmed that this induced species is the flagellin-HPV antigen fusion protein and suggested that both parts of the fusion protein were expressed intact. All recombinant baculoviruses induced expression of a protein band in conditioned Hi-5 cell media which reacted with $His_6$ antibody at the expected molecular weight for the chosen DEN 80% $EHis_6Bv$ protein Protein Purification—Methods Bacterial Growth and Cell Lysis:

STF2Δ.DEN1EIII+ (SEQ ID NO: 628), STF2Δ.DEN2EIII+ (SEQ ID NO:630), STF2Δ.DEN3EIII+ (SEQ ID NO:632) and STF2Δ.DEN4EIII+ (SEQ ID NO: 634) proteins were produced in the *E. coli* host strain BLR (DE3). *E. coli* cells were cultured and harvested as described above. The individual strain was retrieved from a glycerol stock and grown in shake flasks to a final volume of 12 liters. Cells were grown in LB medium containing 50 μg/mL kanamycin/12.5 μg/mL tetracycline/0.5% dextrose to $OD_{600}$=0.6 and induced by the addition of 1 mM IPTG for 3 hours at 37° C. The cells were harvested by centrifugation (about 7000 rpm×about 7 minutes in a Sorvall RC5C centrifuge) and resuspended in 1×PBS, 1% glycerol, 1 μg/mL DNAse I, 1 mM PMSF, protease inhibitor cocktail and 1 mg/mL lysozyme. The cells were then lysed by two passes through a microfluidizer at 15,000 psi. The lysate was then centrifuged at 45,000×g for one hour to separate soluble and insoluble fractions.

Protein Purification:

Following centrifugation, the insoluble (inclusion body) fractions were resuspended in Buffer A (1× Tris-buffered saline, pH 8.0+1% (w/v) Triton X-100) and resusupended using a glass-ball Dounce homogenizer. The resuspended protein was then centrifuged again as above and the insoluble material was recovered. The wash process was repeated 3 times. The insoluble protein was then denatured in Buffer B (8M urea, 20 mM citric acid, pH 3.5). The denatured protein was then applied to a Source SP column (GE Healthcare; Piscataway, N.J.) equilibrated in Buffer B (8 M urea, 20 mM citrate, pH 3.5) and protein was eluted from the resin with a 5 column-volume gradient of 0-100% Buffer C (Buffer B+1M NaCl). The eluted material was extensively dialyzed against Buffer D (8 M urea, 50 mM Tris-HCl, pH 8.0) and then refoled by dilution in a 10-fold volume of Buffer E (50 mM Tris-HCl, pH 8.0). The refolded material was then applied to a Source Q column (GE Healthcare; Piscataway, N.J.) equilibrated in Buffer F (20 mM Tris, pH 8.0) and the bound, monomeric protein was eluted with a 5 column-volume linear salt gradient of 0-100% Buffer G (Buffer F+1M NaCl). Peak fractions were pooled and dialyzed against 1×TBS, pH 8.0, and sterile filtered.

SDS-PAGE and Western Blot Analysis:

Protein identity and purity of STF2Δ.DENEIII+ proteins (SEQ ID NOs: 628, 630, 632, 634) was determined by SDS-PAGE. An aliquot of 5 µg of each sample was diluted in SDS-PAGE sample buffer with or without 100 mM DTT as a reductant. The samples were boiled for 5 minutes and loaded onto a 10% polyacrylamide gel (LifeGels; French's Forest, New South Wales, AUS) and electrophoresed. The gel was stained with Coomassie R250 (Bio-Rad; Hercules, Calif.) to visualize protein bands. For Western Blot, 0.5 μg/lane total protein was electrophoresed as described above and the gels were then electro-transferred to a PVDF membrane and blocked with 5% (w/v) non-fat dry milk before probing with anti-flagellin antibody (Inotek; Beverly, Mass.). After probing with alkaline phosphatase-conjugated secondary antibodies (Pierce; Rockland, Ill.), protein bands were visualized with an alkaline phosphatase chromogenic substrate (Promega; Madison, Wis.).

Protein Assay:

Total protein concentration for all proteins was determined using the Micro BCA (bicinchonic acid) Assay (Pierce; Rockland, Ill.) in the microplate format, using bovine serum albumin as a standard, according to the manufacturer's instructions.

Endotoxin Assay:

Endotoxin levels for all proteins were determined using the QCL-1000 Quantitative Chromogenic LAL test kit (Cambrex; E. Rutherford, N.J.), following the manufacturer's instructions for the microplate method.

TLR Bioactivity Assay:

HEK293 cells constitutively express TLR5, and secrete several soluble factors, including IL-8, in response to TLR5 signaling. Cells were seeded in 96-well microplates (50,000 cells/well), and individual STF2Δ.DEN1-4EIII+ proteins (SEQ ID NOs: 628, 630, 632, 634) was added and incubated overnight. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce; Rockland, Ill.) #M801E and M802B) following the manufacturer's instructions. Optical density was measured using a microplate spectrophotometer (FARCyte, GE Healthcare; Piscataway, N.J.).

Protein Purification—Results

Protein Yield and Purity:

All four STF2Δ.DENEIII+ proteins (SEQ ID NO: 628, 630, 632, 634) were produced in high yield from *E. coli* cell culture. Total yields following purification ranged from 25-50 mg, the purity of all four proteins exceeded 95% by SDS-PAGE, and the endotoxin values for each protein was less than 0.05 EU/μg. All four STF2Δ.DENEIII+ (SEQ ID NOs: 628, 630, 632, 634) fusion proteins had in vitro TLR5 bioactivity. All four DEN 80% $EHis_6Bv$ proteins (SEQ ID NOs: 636, 638, 640, 642) were expressed in Hi-5 cell conditioned medium and purified from 12 L cultures in total yields ranging from about 5 to about 20 mg.

Immunogenicity Testing—Methods

Animal Study #1:

Female C57B/6 mice (Jackson Laboratory, Bar Harbor, Me.) were used at the age of 6-8 weeks. Test proteins were formulated in 100 μl of phosphate-buffered saline. Mice were divided into groups of 10 and received inguinal subcutaneous (s.c.) immunizations on days 0, 14 and 28 as follows. The tetravalent formulation included four fusion proteins that each included four different Dengue antigens ($DEN1EIII^+$, $DEN2EIII^+$, $DEN3EIII^+$, $DEN4EIII^+$ SEQ ID NOs: 628, 630, 632 and 634, respectively).

group

3. PBS (Phosphate-buffered saline)
4. 3 μg of STF2Δ.DEN1EIII+ (SEQ ID NO: 628)
5. 3 μg of STF2Δ.DEN2EIII+ (SEQ ID NO: 630)
6. 3 μg of STF2Δ.DEN3EIII+ (SEQ ID NO: 632)
7. 3 μg of STF2Δ.DEN4EIII+ (SEQ ID NO: 634)
8. Tetravalent Formulation:
   3 μg of STF2Δ.DEN1EIII+ (SEQ ID NO: 628)
   3 μg of STF2Δ.DEN2EIII+ (SEQ ID NO: 630)
   3 μg of STF2Δ.DEN3EIII+ (SEQ ID NO: 632)
   3 μg of STF2Δ.DEN4EIII+ (SEQ ID NO: 634)

Mice were bled by retro-orbital puncture on days 21 and 35. Sera were harvested by clotting and centrifugation of the heparin-free blood samples, and tested by ELISA for reactivity with DEN E proteins.

Animal Study #2:

Female Balb/C mice (Jackson Laboratory, Bar Harbor, Me.) were used at the age of 6-8 weeks. Test proteins were formulated in 100 μl of phosphate-buffered saline. Mice were divided into groups of 10 and received inguinal subcutaneous (s.c.) immunizations on days 0, 14 and 28 as follows:

group

1. PBS (Phosphate-buffered saline)
2. 3 μg of STF2Δ.DEN1EIII+ (SEQ ID NO: 628)
3. 30 μg of STF2Δ.DEN1EIII+ (SEQ ID NO: 628)
4. 3 μg of STF2Δ.DEN2EIII+ (SEQ ID NO: 630)
5. 30 μg of STF2Δ.DEN2EIII+ (SEQ ID NO: 630)
6. 3 μg of STF2Δ.DEN3EIII+ (SEQ ID NO: 632)
7. 30 μg of STF2Δ.DEN3EIII+ (SEQ ID NO: 632)
8. 3 μg of STF2Δ.DEN4EIII+ (SEQ ID NO: 634)
9. 30 μg of STF2Δ.DEN4EIII+ (SEQ ID NO: 634)

Mice were bled by retro-orbital puncture on days 21 and 35. Sera were harvested by clotting and centrifugation of the heparin-free blood samples, and tested by ELISA for reactivity with DEN E proteins.

DEN Serum Antibody Determination:

DEN envelope protein-specific IgG levels were determined by ELISA. ELISA plates (96 wells) were coated overnight at 4° C. with 100 ml/well of the selected DEN 80% E protein (SEQ ID NO: 636; SEQ ID NO: 638; SEQ ID NO: 640; or SEQ ID NO: 642) in PBS at a concentration of 2 μg/ml. Plates were blocked with 200 μl/well of Assay Diluent Buffer (ADB; BD Pharmingen, San Diego, Calif.) for on hour at room temperature. The plates were washed 3× in PBS-T. Dilutions of the sera in ADB were added (100 μl/well) and the plates were incubated overnight at 4° C. The plates were then washed 3× with PBS-T. HRP-labeled goat anti-mouse IgG antibodies (Jackson Immunochemical; West Grove, Pa.) diluted in ADB were added (100 μl/well) and the plates were incubated at room temperature for 1 hour. The plates were washed 3× with PBS-T. After adding TMB (3,3',5,5'-tetramethylbenzidine) Ultra substrate (Pierce Biotechnology; Rockford, Ill.) and monitoring color development, absorbance at 450 nm ($A_{450}$) was measured on a Tecan Farcyte microspectrophotometer.

PRNT$_{50}$ Assays:

The ability of mouse immune sera to neutralize DEN virus infectivity in vitro was determined by the plaque reduction neutralization test (PRNT). Day 35 serum samples from immunized mice were tested for their ability to block DEN virus infection in cultured Vero cells. Briefly, individual mouse serum samples were heat-inactivated and serially diluted two-fold in phosphate-buffered saline (PBS)+0.5% gelatin. Dilutions starting with 1:10 were incubated with 100 Pfu of Dengue 2 virus. The virus/serum mixture was incubated at 37° C. for 1 hour and then inoculated onto confluent monolayers of Vero cells (ATCC, Catalog #CCL-81; Manassas, Va.) in duplicate wells of 6-well tissue culture plates. The virus was allowed to adsorb to the cell monolayer prior to adding a 1% agarose overlay. Infected cell cultures were incubated for 4 days at 37° C. followed by a second agarose overlay containing 4% neutral red. Virus plaques were counted 12 hours later. Serum titers that induced a 50% reduction in viral plaque number (PRNT$_{50}$) were recorded.

Immunogenicity Testing—Results

DEN E—Specific Antibody Responses:

As shown in FIGS. 47A through 47D, immunization of C57B/6 mice with any of the four individual STF2Δ.DENEIII+ proteins (SEQ ID NO: 628; SEQ ID NO: 630; SEQ ID NO: 632; SEQ ID NO: 634) elicited high levels of serum IgG that reacted with the DEN 80% $EHis_6Bv$ protein from the homologous Dengue virus serotype. In contrast, mock immunization (PBS) elicited no DEN 80% $EHis_6Bv$-reactive antibody.

Immune sera from each of the four individually immunized mouse groups were tested for cross-reactivity with DEN 80% $EHis_6Bv$ proteins from the three other heterologous Dengue serotypes. As shown in FIGS. 48A through 48D immunization with the four individual STF2Δ.DENEIII+ proteins (SEQ ID NO: 628; SEQ ID NO: 630; SEQ ID NO: 632; or SEQ ID NO: 634) elicited antibodies more specific for the homologous DEN E protein than for the heterologous DEN E protein. In the case of DEN2, the homologous antibody titer exceeded the highest heterologous titer by approximately 3-fold $\log_{10}$ ($10^3$). For DEN1 and DEN4, the homologous antibody titer exceeded the highest heterologous titer by about 2-fold $\log_{10}$ ($10^3$). For DEN3, there was some cross-reactivity with DEN1, with the homologous response exceeding the heterologous DEN1 response by about 2 fold, and the heterologous response against DEN2 and DEN4 exceeding 1-fold $\log_{10}$.

These data show that DENEIII+ antigens fused to STF2Δ elicit potent antibody responses that are highly specific for the homologous Dengue serotype and are minimally cross-reactive with heterologous serotypes.

In addition to the monovalent administrations, the four STF2Δ.DENEIII+ proteins (SEQ ID NO: 628; SEQ ID NO: 630; SEQ ID NO: 632; or SEQ ID NO: 634) were administrated together as a tetravalent blend. FIGS. 49A, 49B, 50A and 50B show the homologous and heterologous antibody responses elicited by the monovalent and tetravalent formulations. As shown in FIGS. 49A and 49B, immunization with the tetravalent blend elicits anti-DEN1 E and anti-DEN2 E antibody responses that are very similar to those elicited by the monovalent formulations for these two serotypes. As shown in FIGS. 50A and 50B, the antibody response to the DEN3 component in the tetravalent blend STF2Δ.DEN3EIII+ (SEQ ID NO: 632) drops significantly as compared with the monovalent administration of this vaccine construct. This diminished response to DEN3 in the tetravalent blend can be corrected by increasing the amount of STF2Δ.DEN3EIII+ (SEQ ID NO: 632) protein in the tetravalent blend by three-fold over the other 3 DEN serotypes. The antibody response to the DEN4 component in the tetravalent blend, STF2Δ.DEN4EIII+ (SEQ ID NO: 634), is also slightly diminished as compared with the DEN4 monovalent administration.

These data show that a tetravalent formulation of DEN vaccine components, consisting of STF2Δ.DEN1EIII+ (SEQ ID NO: 628), STF2Δ.DEN2EIII+ (SEQ ID NO: 630), STF2Δ.DEN3EIII+ (SEQ ID NO: 632) and STF2Δ.DEN4EIII+ (SEQ ID NO: 634) can elicit potent and specific antibody responses against all four Dengue E protein serotypes, and that diminished responses caused by immune interference between the individual components can be corrected by adjusting the ratios of the components in the tetravalent formulation.

Animal Study #1

In Vitro Neutralization of Dengue Virus Infectivity:

The ability to elicit Dengue virus-neutralizing antibodies is essential for vaccine efficacy. Individual immune sera from mice immunized with STF2Δ.DEN2EIII+ (SEQ ID NO: 630) were tested for virus neutralization in a plaque-reduction neutralization test (PRNT) assay. The results of this assay are shown in FIG. 51. The majority of mice (9/10=90%) immunized with STF2Δ.DEN2EIII+ (SEQ ID NO: 630) sero-converted, defined as having a $PRNT_{50}$ titer ≥$20^{-1}$, whereas no mice in the control (PBS) group developed neutralizing antibodies. The $PRNT_{50}$ titer in the immunized group ranged from 1:20 to 1:160. These results demonstrate that immunization with STF2Δ.DEN2EIII+ (SEQ ID NO: 630) elicits potent, neutralizing antibodies. None of the sera from C57B/6 mice immunized with STF2Δ.DEN1EIII+ (SEQ ID NO: 628), STF2Δ.DEN3EIII+ (SEQ ID NO: 632) and STF2Δ.DEN4EIII+ (SEQ ID NO: 634) seroconverted with $PRNT_{50}$ titer ≥$20^{-1}$.

Animal Study #2:

As with The C57B/6 mice in Study #1, Balb/C mice immunized with STF2Δ.DEN1EIII+ (SEQ ID NO: 628), STF2Δ.DEN2EIII+ (SEQ ID NO: 630), STF2Δ.DEN3EIII+ (SEQ ID NO: 632) or STF2Δ.DEN4EIII+ (SEQ ID NO:634) developed high levels of serum IgG reactive with the homologous DEN 80% E in ELISA assays.

Individual immune sera from Balb/C mice immunized with STF2Δ.DEN1EIII+ (SEQ ID NO: 628), STF2Δ.DEN2EIII+ (SEQ ID NO: 630), STF2Δ.DEN3EIII+ (SEQ ID NO: 632) or STF2Δ.DEN4EIII+ (SEQ ID NO:634) were tested for virus neutralization in a plaque-reduction neutralization test (PRNT) assay. The results of these assays are shown in Tables 25A and 25B.

All mice immunized with either STF2Δ.DEN1EIII+ (SEQ ID NO: 628) and STF2Δ.DEN2EIII+ (SEQ ID NO: 630) seroconverted, which is represents a $PRNT_{50}$ titer about ≥$20^{-1}$, whereas no mice in the control (PBS) group developed neutralizing antibodies. The $PRNT_{50}$ geometric mean titers in the 3 μg immunized groups were about $439^{-1}$ and about $1365^{-1}$ for DEN1 and DEN2, respectively. The majority of mice (9/10 or 90%) immunized with 3 μg of STF2Δ.DEN3EIII+ (SEQ ID NO: 632) seroconverted, with a geometric mean titer of about $19^{-1}$, while 4 of 10 mice immunized with 30 μg of STF2Δ.DEN3EIII+ (SEQ ID NO: 632) seroconverted, with a geometric mean titer of about $12^{-1}$. No mice immunized with STF2Δ.DEN4EIII+ (SEQ ID NO: 634) seroconverted.

The serum neutralization titers from Balb/C mice immunized with STF2Δ.DEN1EIII+ (SEQ ID NO: 628), STF2Δ.DEN2EIII+ (SEQ ID NO: 630), STF2Δ.DEN3EIII+ (SEQ ID NO: 632) are better than those from C57B/6 mice both in terms of potency and breadth of response to the various Dengue serotypes, which shows that the DEN1, 2 and 3 fusion proteins can elict virus neutralizing antibodies. This difference with animals in study #1 (C57B/6 mice) may be due, in part, to differences in the immune response to the flagellin component of the vaccine between these two genetically distinct mouse strains. The magnitude of the immune response may vary between mouse strains, with the C57B/6 strain being hypo-responsive relative to Balb/C.

The inability to detect neutralizing antibodies to DEN4 component of the fusion protein, STF2Δ.DEN4EIII+ (SEQ ID NO: 634) to elicit neutralizing antibodies in both the C57B/6 and Balb/C mouse strains may be due one or a combination of different factors. For example, the DEN4 EIII+ domain of the fusion protein may not have refolded in the purification process to a conformation which properly presents critical neutralizing epitopes to the immune system. Another possibility is physical interactions between the flagellin and antigen domains block the presentation of critical epitopes to the immune system, a phenomenon seen with other flagellin-antigen fusions. It is possible additional constructs that include alternative flagellin constructs with Dengue 4 viral antigens may result in neutralization.

TABLE 25A

| Immunogen | STF2Δ.DEN1EIII + (SEQ ID NO: 628) | STF2Δ.DEN1EIII + (SEQ ID NO: 628) | STF2Δ.DEN2EIII + (SEQ ID NO: 630) | STF2Δ.DEN2EIII + (SEQ ID NO: 630) |
|---|---|---|---|---|
| Dose | 3 μg | 30 μg | 3 μg | 30 μg |
| Geometric mean titer | 493 | 331 | 1365 | 517 |
| range | 120-5120 | 60-1600 | 480-5120 | 160-1920 |
| seroconversion | 10/10 | 10/10 | 10/10 | 10/10 |

TABLE 25B

| Immunogen | STF2Δ.DEN3EIII + (SEQ ID NO: 632) | STF2Δ.DEN3EIII + (SEQ ID NO: 632) | STF2Δ.DEN4EIII + (SEQ ID NO: 634) | STF2Δ.DEN4EIII + (SEQ ID NO: 634) |
|---|---|---|---|---|
| Dose | 3 μg | 30 μg | 3 μg | 30 μg |
| Geometric mean titer | 19 | 12 | 5 | 5 |
| range | 5-40 | 5-80 | 5-5 | 5-5 |
| seroconversion | 9/10 | 4/10 | 0/10 | 0/10 |

Example 12

Cloning, Production and Immunogenicity Testing of Recombinant Flagellin-HPV Antigen Fusion Proteins in E. coli Methods
DNA Cloning:

Synthetic genes encoding the E6, E7 and L2 proteins of Human Papilloma Virus strain 16 (HPV 16) were codon optimized for expression in E. coli and synthesized by a commercial vendor (DNA 2.0; Menlo Park, Calif.). The genes were designed to incorporate flanking BlpI sites on both the 5' and 3' ends. The gene fragments were excised from the respective plasmids with BlpI and cloned by compatible ends into either the STF2.blp or STF2Δ.blp vector cassette. The fusion constructs incorporating the full-length flagellin gene were designated STF2.E6 (SEQ ID NO: 667), STF2.E7 (SEQ ID NO: 668) and STF2.L2. (SEQ ID NO: 669). The analogous constructs for the flagellin gene lacking a hinge region (also referred to herein as "truncated flagellin") were designated as STF2Δ.E6 (SEQ ID NO: 670), STF2Δ.E7 (SEQ ID NO: 671) and STF2Δ.L2 (SEQ ID NO: 672). In addition, a synthetic gene combining E6 and E7 was fused with STF2 and STF2Δ to create STF2.E6E7 (SEQ ID NO: 673) and STF2Δ.E6E7 (SEQ ID NO: 674), respectively.

In each case, the constructed plasmids were used to transform competent E. coli TOP10 cells and putative recombinants were identified by PCR screening and restriction mapping analysis. The integrity of the constructs was verified by DNA sequencing, constructs were used to transform the expression host, BLR(DE3) (Novagen, San Diego, Calif.; Cat #69053). Transformants were selected on plates containing kanamycin (50 μg/mL), tetracycline (5 μg/mL) and glucose (0.5%). Colonies were picked and inoculated into 2 mL of LB medium supplemented with 25 μg/mL kanamycin, 12.5 μg/mL tetracycline and 0.5% glucose and grown overnight. Aliquots of these cultures were used to innoculate fresh cultures in the same medium formulation, which were cultured until an optical density ($OD_{600}$)=0.6 was reached, at which time protein expression was induced by the addition of 1 mM IPTG and cultured for 3 hours at 37° C. The cells were then harvested and analyzed for protein expression.

SDS-PAGE and Western Blot:

Protein expression and identity were determined by gel electrophoresis and immunoblot analysis. Cells were harvested by centrifugation and lysed in Laemmli buffer. An aliquot of 10 μl of each lysate was diluted in SDS-PAGE sample buffer with or without 100 mM dithiothreitol (DTT) as a reductant. The samples were boiled for 5 minutes and loaded onto a 10% SDS polyacrylamide gel and electrophoresed by SDS-PAGE. The gel was stained with Coomassie R-250 (Bio-Rad; Hercules, Calif.) to visualize protein bands. For Western Blot, 0.5 ml/lane of cell lysate was electrophoresed and electrotransfered onto a PVDF membrane and blocked with 5% (w/v) dry milk.

The membrane was then probed with anti-flagellin antibody (Inotek; Beverly, Mass.). After probing with alkaline phosphatase-conjugated secondary antibody (Pierce; Rockland, Ill.), protein bands were visualized with an alkaline phosphatase chromogenic substrate (Promega, Madison, Wis.). Bacterial clones which yielded protein bands of the correct molecular weight and reactive with the appropriate antibodies were selected for production of protein for use in biological assays and animal immunogenicity experiments.

DNA constructs linking flagellin with HPV 16 antigens are listed in Table 24.

TABLE 24

Flagellin - HPV 16 antigen DNA constructs for expression in E. coli

| SEQ ID NO: | Construct | Predicted molecular weight (Da) |
|---|---|---|
| 667 | STF2.E6 | 71,489 |
| 668 | STF2.E7 | 63,323 |
| 673 | STF2.E6E7 | 82,362 |
| 670 | STF2Δ.E6 | 48,495 |
| 671 | STF2Δ.E7 | 40,330 |
| 674 | STF2Δ.E6E7 | 59,369 |
| 669 | STF2.L2 | 103,009 |
| 672 | STF2Δ.L2 | 80,016 |
| 675 | STF2.E6. CTLHis$_6$ | 55,402 |
| 676 | STF2.4xE6CTLHis$_6$ | 61,394 |
| 677 | STF2.E7.CTLHis$_6$ | 55,600 |
| 678 | STF2.4xE7CTLHis$_6$ | 62,187 |
| 115 | HPV16E6His$_6$ | 20,010 |
| 117 | HPV16E7His$_6$ | 11,845 |
| 119 | HPV16E6E7His$_6$ | 30,833 |
| 121 | HPV16L2His$_6$ | 51,531 |

Results

As assayed by Coomassie blue staining of the SDS-PAGE gel, all the clones displayed a band that migrated at the expected molecular weight. The absence of this band in the control culture (without IPTG) indicates that it is specifically induced by IPTG. Western blotting with antibodies specific for flagellin confirmed that this induced species is the flagellin-HPV antigen fusion protein and suggested that both parts of the fusion protein were expressed intact.

Purification of STF2.HPV16 E6 (SEQ ID NO: 679)

Methods

Bacterial Growth and Cell Lysis:

STF2.HPV16E6 (SEQ ID NO: 679) was expressed in the E. coli host strain BLR (DE3). E. coli cells were cultured and harvested as described above. The individual strain was retrieved from a glycerol stock and grown in shake flasks to a final volume of 12 liters. Cells were grown in LB medium containing 50 µg/mL kanamycin/12.5 µg/mL tetracycline/ 0.5% dextrose to OD$_{600}$=0.6 and induced by the addition of 1 mM IPTG for 3 hours at 37° C. The cells were harvested by centrifugation (7000 rpm×7 minutes in a Sorvall RC5C centrifuge) and resuspended in 1×PBS, 1% glycerol, 1 µg/mL DNAse I, 1 mM PMSF, protease inhibitor cocktail and 1 mg/mL lysozyme. The cells were then lysed by two passes through a microfluidizer at 15,000 psi. The lysate was then centrifuged at 45,000×g for one hour to separate soluble and insoluble fractions.

Purification of STF2.HPV16E6 (SEQ ID NO: 679) from E. coli:

Following cell lysis and centrifugation (see above) the supernatant (soluble) fraction was collected and supplemented with 50 mM Tris, pH 8. The solution was then applied to a Source Q anion exchange column (GE Healthcare: Piscataway, N.J.) equilibrated in Buffer A (50 mM Tris, pH 8.0+5 mM EDTA). Flow-through and eluate fractions were assayed by SDS-PAGE followed by Coomassie blue staining and Western blotting.

The flagellin-E6 fusion protein did not bind to the column and was found in the flow-through fraction. The flow-through fraction was dialyzed overnight to Buffer B (20 mM citric acid, pH 3.5/8M urea/5 mM EDTA/1 mM beta-mercaptoethanol) and applied to a Source S cation exchange column equilibrated in Buffer B. After eluting with a 5 column-volume linear gradient of 0-1M NaCl in Buffer B, eluate fractions were assayed by SDS-PAGE with Coomassie blue staining and Western blotting. The flagellin-E6 protein did not bind to this column and was again recovered in the flow-through fraction. The flow-through fraction was dialyzed overnight to Buffer C (50 mM Tris, pH 8.0/5 mM EDTA/8M urea) and applied to a Source Q anion exchange column (GE Healthcare; Piscataway, N.J.) equilibrated in Buffer C. After eluting with a 5 column linear gradient of 0-1M NaCl in Buffer C, flow-thru and eluate fractions were assayed by SDS-PAGE followed by Coomassie blue staining and Western blotting. The flagellin-E6 protein did not bind to this column and was again found in the flow-through fraction. The flagellin-E6 protein was refolded by ten-fold dilution into Buffer D (20 mM Tris, pH 8.0/0.15M NaCl/2 mM EGTA/2 µM ZnCl$_2$) and applied to a Superdex 200 size-exclusion column (GE Healthcare; Piscataway, N.J.) equilibrated in Buffer D. Eluate fractions were assayed by SDS-PAGE followed by Coomassie blue staining and Western blotting. Peak fractions were pooled, sterile filtered and stored at −80° C.

SDS-PAGE and Western Blot Analysis:

Protein identity and purity of STF2.HPV16 E6 (SEQ ID NO: 679) was determined by SDS-PAGE. An aliquot of 5 µg of each sample was diluted in SDS-PAGE sample buffer with or without 100 mM DTT as a reductant. The samples were boiled for 5 minutes and loaded onto a 10% polyacrylamide gel (LifeGels; French's Forest, New South Wales, AUS) and electrophoresed. The gel was stained with Coomassie R250 (Bio-Rad; Hercules, Calif.) to visualize protein bands. For western blot, 0.5 µg/lane total protein was electrophoresed as described above and the gels were then electro-transferred to a PVDF membrane and blocked with 5% (w/v) non-fat dry milk before probing with anti-flagellin antibody (Inotek; Beverly, Mass.). After probing with alkaline phosphatase-conjugated secondary antibodies (Pierce; Rockland, Ill.), protein bands were visualized with an alkaline phosphatase chromogenic substrate (Promega; Madison, Wis.).

Protein Assay:

Total protein concentration for all proteins was determined using the Micro BCA (bicinchonic acid) Assay (Pierce; Rockland, Ill.) in the microplate format, using bovine serum albumin as a standard, according to the manufacturer's instructions.

Endotoxin Assay:

Endotoxin levels for all proteins were determined using the QCL-1000 Quantitative Chromogenic LAL test kit (Cambrex; E. Rutherford, N.J.), following the manufacturer's instructions for the microplate method.

TLR Bioactivity Assay:

HEK293 cells constitutively express TLR5, and secrete several soluble factors, including IL-8, in response to TLR5 signaling. Cells were seeded in 96-well microplates (50,000 cells/well), and STF2.HPV16 E6 (SEQ ID NO: 679) was added and incubated overnight. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce; Rockland, Ill.) #M801E and M802B) following the manufacturer's instructions. Optical density was measured using a microplate spectrophotometer (FARCyte, GE Healthcare; Piscataway, N.J.).

Animal Studies:

Female C57B/6 mice (Jackson Laboratory, Bar Harbor, Me.) were used at the age of 6-8 weeks. Mice were divided into groups of 6 and received inguinal subcutaneous (s.c.) immunizations on days 0 and 14 as follows:

9. PBS (Phosphate-buffered saline)
10. 3 µg of STF2.HPV16 E6 (SEQ ID NO: 679) in PBS
11. 30 µg STF2.HPV16E6 (SEQ ID NO: 679) in PBS
12. 3 µg of STF2.HPV16E6 (SEQ ID NO: 679) formulated in TiterMax Gold adjuvant (CytRx; Norcross, Ga.), according to the manufacturer's instructions.
13. 30 µg of STF2.HPV16 E6 (SEQ ID NO: 679) formulated in TiterMax Gold adjuvant.

Seven (7) days following the primary immunization and seven (7) days following the booster immunization, 2 animals from each group were sacrificed, spleens removed and splenocytes used in ELISPOT assays to analyze antigen-specific immune responses.

Antigen-Specific ELISPOT Assays:

Spleen cells ($10^6$ cells/well) from animals 7 days following the primary immunization or 7 days following the booster immunization with of STF2.HPV16 E6 (SEQ ID NO: 679) were added to 96-well Multiscreen-IP plates (Millipore; Billerica, Mass.) coated with anti-IFNγ or IL-5 capture antibody (eBioscience; San Diego, Calif.) diluted in PBS according to the manufacturer's instructions. T cells were then stimulated overnight with naïve antigen-presenting cells (APCs) ($10^6$ cells/well) in the absence or presence of a HPV E6-specific antigenic peptide, NH$_3$-EVYDFAFRDL-COOH (AnaSpec; San Jose, Calif.) (SEQ ID NO: 680). Anti-CD3 (BD Pharmingen; San Jose, Calif.) was used as a positive control at a final concentration of 0.25 μg/ml. Plates were incubated overnight at 37° C./5% $CO_2$, then washed and incubated with biotinylated detection antibody diluted in PBS/10% fetal bovine serum (FBS) according to the manufacturer's instructions. Plates were developed using the ELISPOT Blue Color Development Module according to the manufacturer's protocol (R&D Systems; Minneapolis, Minn.). Antigen-specific responses were assayed in duplicate from individual animals and quantified using an automated ELISPOT reader (Cellular Technology Ltd.; Cleveland, Ohio). Data is represented as the number of antigen-specific responses/$10^6$ APC.

Results and Discussion

Protein Yield and Purity:

STF2.HPV16 E6 (SEQ ID NO: 679) was produced in high yield from *E. coli* cell culture. After purification the yield was about 5.7 mg total protein, the purity was estimated to be greater than about 85% by SDS-PAGE, with an endotoxin level of about 0.97 EU/μg. However, the final size exclusion chromatography (SEC) step in the purification showed the STF2.HPV16 E6 (SEQ ID NO: 679) protein eluting in the void volume (data not shown). This result suggested that the protein is not monomeric and is likely to be aggregated. The STF2.HPV16 E6 (SEQ ID NO: 679) fusion protein showed positive in vitro TLR5 bioactivity, albeit lower than that usually seen for monomeric flagellin-antigen fusion proteins Immunogenicity of STF2.HPV16 E6 (SEQ ID NO: 679):

The results of the ELISPOT assay indicate that mice developed antigen-specific T cell responses following a single immunization with STF2.HPV E6 (SEQ ID NO: 679) and that mock-immunized mice did not. Upon stimulation with antigen presenting cells (APCs) primed with the HPV16 E6 peptide (SEQ ID NO: 680), approximately 10 cells/$10^6$ splenocytes secreted IFN-γ, vs. none in the mock immunized group. A similar number of cells from animals immunized with STF2.HPV16 E6 (SEQ ID NO: 679) secreted IL-5, vs. approximately 3 in the mock group. Naïve APCs mock-primed with buffer did not stimulate production of IFN-γ or IL-5 in any of the groups. As a positive control, half of the mouse groups were immunized with STF2.HPV16 E6 (SEQ ID NO: 679) protein formulated in TiterMax Gold adjuvant (CytRx; Norcross, Ga.). Not surprisingly, this powerful adjuvant (which is not acceptable for human use) significantly boosted the number of IFN-γ and IL-5 secreting cells.

ELISPOT assays performed on spleen cells harvested 7 days following the booster immunization with STF2.HPV16 E6 (SEQ ID NO: 679) showed a significant increase in E6 antigen-specific T-cell responses over cells harvested following the primary immunization. Upon stimulation with antigen presenting cells (APCs) primed with the HPV16 E6 peptide (SEQ ID NO: 680), >150 cells/$10^6$ splenocytes in the 3 μg group and >50 cells/$10^6$ splenocytes in the 30 μg group secreted IFN-γ. >40 cells/$10^6$ splenocytes in the 3 μg group and >20 cells/$10^6$ splenocytes in the 30 μg group secreted IL-5. Fewer than 10 cells/$10^6$ splenocytes in the mock-immunized group secreted IFN-γ or IL-5. Thus, in both post-boost dose groups the IFN-γ response predominated over the IL-5 response, whereas these responses were roughly equivalent when assayed following the primary immunization. As seen with mice receiving only one immunization, mice immunized twice with STF2.HPV16 E6 (SEQ ID NO: 679) protein formulated in TiterMax Gold adjuvant (CytRx; Norcross, Ga.) showed an enhanced T-cell response as compared with mice immunized twice with STF2.HPV16 E6 (SEQ ID NO: 679) protein formulated in PBS only.

One factor which may influence the immune response elicited by STF2. HPV16 E6 (SEQ ID NO: 679) in this experiment is the aggregated state of the STF2.HPV16 E6 (SEQ ID NO: 209) fusion protein, which may hinder the flagellin domain from signaling properly through TLR5. Monomeric STF2.HPV16 E6 (SEQ ID NO: 679) fusion protein may elicit stronger antigen-specific T-cell responses. Mutation of one or more cysteine residues in the E6 protein to another amino acid may result in an E6-flagellin fusion protein which is monomeric or less aggregated than the wild-type E6-flagellin fusion protein by eliminating or decreasing the possibility of inappropriate disulfide bonding.

EQUIVALENTS

While this invention has been particularly shown and described with references to example embodiments thereof, it will be understood by those skilled in the art that various changes in form and details may be made therein without departing from the scope of the invention encompassed by the appended claims.

SEQUENCE LISTING (850 sequences)

SEQ ID NO: 1 - protein, 8 aa, Artificial Sequence
  TLR4 ligand
GGKSGRTG

SEQ ID NO: 2 - protein, 9 aa, Artificial Sequence
  TLR4 ligand
KGYDWLVVG

SEQ ID NO: 3 - protein, 10 aa, Artificial Sequence
  TLR4 ligand
EDMVYRIGVP

SEQ ID NO: 4 - protein, 5 aa, Artificial Sequence
  TLR2 ligand
NPPTT

SEQ ID NO: 5 - protein, 5 aa, Artificial Sequence
  TLR2 ligand
MRRIL

SEQ ID NO: 6 - protein, 4 aa, Artificial Sequence
  TLR2 ligand
MISS

SEQ ID NO: 7 - protein, 5 aa, Artificial Sequence
  TLR2 ligand
RGGSK

SEQ ID NO: 8 - protein, 23 aa, Artificial Sequence
  OprI lipoprotein
MNNVLKFSALALAAVLATGCSSH

SEQ ID NO: 9 - DNA, 72 bp, Artificial Sequence
  OprI lipoprotein
atgaaagctactaaactggtactgggcgcggtaatcctgggttctactctgctggcaggttgctccagcaac

SEQ ID NO: 10 - protein, 24 aa, Artificial Sequence
  E. coli lipoprotein
MKATKLVLGAVILGSTLLAGCSSN

SEQ ID NO: 11 - DNA, 72 bp, Artificial Sequence; identical to SEQ ID NO: 9
  E. coli lipoprotein

SEQ ID NO: 12 - protein, 506 aa, Artificial Sequence
  Flagellin
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 13 - protein, 494 aa, Artificial Sequence
  Flagellin
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLR

SEQ ID NO: 14 - protein, 506 aa, Artificial Sequence; identical to SEQ ID NO: 12
  Flagellin

SEQ ID NO: 15 - protein, 277 aa, Artificial Sequence
  Flagellin
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 16 - protein, 506 aa, Artificial Sequence
  Flagellin
MAQVINTNSLSLLTQNNLNKSQSALGTAIERLSSGLRINSAKDDAAGQAIANRFTANIKGLTQASRNANDGISIAQTTEGALNEINNNLQRVRELAVQSANGTNSQSDLDSIQAEITQRLNEIDRVSGQTQFNGVKVLAQDNTLTIQVGANDGETIDIDLKEISSKTLGLDKLNVQDAYTPKETAVTVDKTTYKNGTDTITAQSNTDIQTAIGGGATGVTGADIKFKDGQYYLDVKGGASAGVYKATYDETTKKVNIDTTDKTPLATAEATAIRGTATITHNQIAEVTKEGVDTTTVAAQLAAAGVTGADKDNTSLVKLSFEDKNGKVIDGGYAVKMGDDFYAATYDEKTGTITAKTTTYTDGAGVAQTGAVKFGGANGKSEVVTATDGKTYLASDLDKHNFRTGGELKEVNTDKTENPLQKIDAALAQVDTLRSDLGAVQNRFNSAITNLGNTVNNLSSARSRIEDSDYATEVSNMSRAQILQQAGTSVLAQANQVPQNVLSLLR

SEQ ID NO: 17 - protein, 504 aa, Artificial Sequence
  Flagellin
AQVINTNSLSLLTQNNLNKSQSALGTAIERLSSGLRINSAKDDAAGQAIANRFTANIKGLTQASRNANDGISIAQTTEGALNEINNNLQRVRELAVQSANGTNSQSDLDSIQAEITQRLNEIDRVSGQTQFNGVKVLAQDNTLTIQVGANDGETIDIDLKEISSKTLGLDKLNVQDAYTPKETAVTVDKTTYKNGTDTITAQSNTDIQTAIGGGATGVTGADIKFKDGQYYLDVKGGASAGVYKATYDETTKKVNIDTTDKTPLATAEATAIRGTATITHNQIAEVTKEGVDTTTVAAQLAAAGVTGADKDNTSLVKLSFEDKNGKVIDGGYAVKMGDDFYAATYDEKQVQLLLNNHYTDGAGVLQTGAVKFGGANGKSEVVTATVGKTYLASDLDKHNFRTGGELKEVNTDKTENPLQKIDAALAQVDTLRSDLGAVQNRFNSAITNLGNTVNNLSSARSRIEDSDYATEVSNMSRAQILQQAGTSVLAQANQVPQNVLSLLR

SEQ ID NO: 18 - protein, 393 aa, Artificial Sequence
  Flagellin
ALTVNTNIASLNTQRNLNNSSASLNTSLQRLSTGSRINSAKDDAAGLQIANRLTSQVNGLNVATKNANDGISLAQTAEGALQQSTNILQRMRDLSLQSANGSNSDSERTALNGEVKQLQKELDRISNTTTFGGRKLLDGSFGVASFQVGSAANEIISVGIDEMSAESLNGTYFKADGGGAVTAATASGTVDIAIGITGGSAVNVKVDMKGNETAEQAAAKIAAAVNDANVGIGAFSDGDTISYVSKAGKDGSGAITSAVSGVVIADTGSTGVGTAAGVTPSATAFAKTNDTVAKIDISTAKGAQSAVLVIDEAIKQIDAQRADLGAVQNRFDNTINNLKNIGENVSAARGRIEDTDFAAETANLTKNQVLQQAGTAILAQANQLPQSVLSLLR

SEQ ID NO: 19 - protein, 287 aa, Artificial Sequence
  Flagellin
MKVNTNIISLKTQEYLRKNNEGMTQAQERLASGKRINSSLDDAAGLAVVTRMNVKSTGLDAASKNSSMGIDLLQTADSALSSMSSILQRMRQLAVQSSNGSFSDEDRKQYTAEFGSLIKELDHVADTTNYNNIKLLDQTATNAATQVSIQASDKANDLINIDLFNAKGLSAGTITLGSGSTVAGYSALSVADADSSQEATEAIDELINNISNGRALLGAGMSRLSYNVSNVNNQSIATKASASSIEDADMAAEMSEMTKYKILTQTSISMLSQANQTPQMLTQLINS

SEQ ID NO: 20 - protein, 595 aa, Artificial Sequence
  Flagellin
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDLTAAKMDAATNTITTTNNALTASKALDQLKDGDTVTIKADAAQTATVYTYNASAGNFSLSNVSNNTSEKAGDVAASLLPPAGQTASGVYKAASGEVNFDVDANGKITIGGQKAYLTSDGNLTTNDAGGATAATLDGLFKKAGDGQSIGFKKTASVTMGGTTYNFKTGADADAATANAGVSFTDTASKETVLNKVATAKQGKAAAADGDTSATITYKSGVQTYQAVFAAGDGTASAKYADKADVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQVPQQVLSLLQG

SEQ ID NO: 21 - protein, 497 aa, Artificial Sequence
  Flagellin
AQVINTNSLSLITQNNINKNQSALSSSIERLSSGLRINSAKDDAAGQAIANRFTSNIKGLTQAARNANDGISVAQTTEGALSEINNNLQRVRELTVQATTGTNSESDLSSIQDEIKSRLDEIDRVSGQTQFNGVNVLAKNGSMKIQVGANDNQTITIDLKQIDAKTLGLDGFSVKNNDTVTTSAPVTAFGATTTNNIKLTGITLSTEAATDTGGTNPASIEGVYTDNGNDYYAKITGGDNDGKYYAVTVANDGTVTMATGATANATVTDANTTKATTITSGGTPVQIDNTAGSATANLGAVSLVKLQDSKGNDTDTYALKDTNGNLYAADVNETTGAVSVKTITYTDSSGAASSPTAVKLGGDDGKTEVVDIDGKTYDSADLNGGNLQTGLTAGGEALTAVANGKTTDPLKALDDAIASVDKFRSSLGAVQNRLDSAVTNLNNTTTNLSEAQSRIQDADYATEVSNMSKAQIIQQAGNSVLAKANQVPQQVLSLLQG

SEQ ID NO: 22 - protein, 506 aa, Artificial Sequence; identical to SEQ ID NO: 12
  Flagellin STF2

SEQ ID NO: 23 - DNA, 1518 bp, Artificial Sequence
  Flagellin
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgt

SEQ ID NO: 24 - DNA, 832 bp, Artificial Sequence
  Flagellin
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtg

SEQ ID NO: 25 - DNA, 1522 bp, Artificial Sequence
  Flagellin
aatggcacaagtcattaatacaaacagcctgtcgctgttgacccagaataacctgaacaaatcccagtccgctctgggcaccgctatcgagcgtctgtcttccggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacggtactaactcccagtctgaccttgactctatccaggctgaaatcacccagcgtctgaacgaaatcgaccgtgtatccggtcagactcagttcaacggcgtgaaagtcctggcgcaggacaacaccctgaccatccaggttggtgccaacgacggtgaaactattgatattgatttaaaagaaattagctctaaaacactgggacttgataagcttaatgtccaggatgcctacaccccgaaagaaactgctgtaaccgttgataaaactacctataaaaatggtacagatactattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttagcaactgcggaagctacagctattcggggaacggccactataacccacaaccaaattgctgaagtaacaaaagagggtgttgatacgaccacagttgcggctcaacttgctgctgcaggggttactggtgccgataaggacaatactagccttgtaaaactatcgtttgaggataaaaacggtaaggttattgatggtggctatgcagtgaaaatgggcgacgatttctatgccgctacatatgatgagaaaacaggtacaattactgctaaaacaaccacttatacagatggtgctggcgttgctcaaactggagctgtgaaatttggtggcgcaaatggtaaatctgaagttgttactgctaccgatggtaaaacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggtacagaaccgtttcaactccgctatcaccaacctgggcaataccgtaaataacctgtcttctgcccgtagccgtatcgaagattccgactacgcgaccgaagtctccaacatgtctcgcgcgcagattctgcagcaggccggtacctccgttctggcgcaggctaaccaggttccgcaaaacgtcctctctttactgcgttaa

SEQ ID NO: 26 - DNA, 1788 bp, Artificial Sequence
  Flagellin
atggcacaagtcattaataccaacagcctctcgctgatcactcaaaataatatcaacaagaaccagtctgcgctgtcgagttctatcgagcgtctgtcttctggcttgcgtattaacagcgcgaaggatgacgccgcaggtcaggcgattgctaaccgttttacttctaacattaaaggcctgactcaggctgcacgtaacgccaacgacggtatttccgttgcgcagaccaccgaaggcgcgctgtccgaaatcaacaacaacttacagcgtatccgtgaactgacggttcaggcttctaccgggactaactccgattcagatctggactccattcaggacgaaatcaaatcccgtctggacgaaattgaccgcgtatctggccagacccagttcaacggcgtgaacgtactggcgaaagacggttcaatgaaaattcaggttggtgcgaatgacggccagactatcacgattgatctgaagaaaattgactcagatacgctggggctgaatggttttaacgtgaatggttccggtacgatagccaataaagcggcgaccattagcgacctgacagcagcgaaaatggatgctgcaactaatactataactacaacaaataatgcgctgactgcatcaaaggcgcttgatcaactgaaagatggtgacactgttactatcaaagcagatgctgctcaaactgccacggtttatacatacaatgcatcagctggtaacttctcactcagtaatgtatcgaataatacttcagaaaaagcaggtgatgtagcagctagccttctcccgccggctgggcaaactgctagtggtgtttataaagcagcaagcggtgaagtgaactttgatgttgatgcgaatggtaaaatcacaatcggaggacagaaagcatatttaactagtgatggtaacttaactacaaacgatgctggtggtgcgactgcggctacgcttgatggtttattcaagaaagctggtgatggtcaatcaatcgggtttaagaagactgcatcagtcacgatggggggaacaacttataactttaaaacgggtgctgatgctgatgctgcaactgctaacgcaggggtatcgttcactgatacagctagcaaagaaaccgttttaaataaagtggctacagctaaacaaggcaaagcagctgcagctgacggtgatacatccgcaacaattacctataaatctggcgttcagacgtatcaggctgtatttgccgcaggtgacggtactgctagcgcaaaatatgccgataaagctgacgtttctaatgcaacagcaacatacactgatgctgatggtgaaatgactacaattggttcatacaccacgaagtattcaatcgatgctaacaacggcaaggtaactgttgattctggaactggtacgggtaaatatgcgccgaaagtaggggctgaagtatatgttagtgctaatggtactttaacaacagatgcaactagcgaaggcacagtaacaaaagatccactgaaagctctggatgaagctatcagctccatcgacaaattccgttcttccctgggtgctatccagaaccgtctggattccgcagtcaccaacctgaacaacaccactaccaacctgtccgaagcgcagtcccgtattcaggacgccgactatgcgaccgaagtgtccaacatgtcgaaagcgcagatcattcagcaggccggtaactccgtgctggcaaaagccaaccaggtaccgcagcaggttctgtctctgctgcagggttag

SEQ ID NO: 27 - DNA, 1518 bp, Artificial Sequence
  Flagellin STF2
atggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactacga

SEQ ID NO: 28 - protein, 418 aa, Artificial Sequence
  STF2R0
GQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSR

SEQ ID NO: 29 - protein, 405 aa, Artificial Sequence
  R3 protein D3 protein
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 30 - protein, 317 aa, Artificial Sequence
  R3D0 R0R3 or R03 protein
GQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSR

SEQ ID NO: 31 - protein, 359 aa, Artificial Sequence
  D3N protein
GQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 32 - protein, 349 aa, Artificial Sequence
  D3NCs protein
GQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQ

SEQ ID NO: 33 - protein, 180 aa, Artificial Sequence
  D0D2D3 protein
GQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEARSR

SEQ ID NO: 34 - protein, 277 aa, Artificial Sequence; identical to SEQ ID NO: 15
  STF2delta

SEQ ID NO: 35 - DNA, 1257 bp, Artificial Sequence
  STF2R0
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgt

SEQ ID NO: 36 - DNA, 1215 bp, Artificial Sequence
  R3 2xAntigen D3
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcg

SEQ ID NO: 37 - DNA, 954 bp, Artificial Sequence
  R3D0 or R0R3
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgt

SEQ ID NO: 38 - DNA, 1080 bp, Artificial Sequence
  D3N
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcg

SEQ ID NO: 39 - DNA, 1050 bp, Artificial Sequence
  D3NCs
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccag

SEQ ID NO: 40 - DNA, 543 bp, Artificial Sequence
  D0D2D3
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgt

SEQ ID NO: 41 - protein, 535 aa, Artificial Sequence
  CRM197
GADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 42 - protein, 164 aa, Artificial Sequence
  TMV coat protein
MMAYSIPTPSQLVYFTENYADYIPFVNRLINARSNSFQTQSGRDELREILIKSQVSVVSPISRFPAEPAYYIYLRDPSISTVYTALLQSTDTRNRVIEVENSTNVTTAEQLNAVRRTDDASTAIHNNLEQLLSLLTNGTGVFNRTSFESASGLTWLVTTTPRTA

SEQ ID NO: 43 - protein, 221 aa, Artificial Sequence
  AMV
MSSSQKKAGGKAGKPTKRSQNYAALRKAQLPKPPALKVPVAKPTNTILPQTGCVWQSLGTPLSLSSSNGLGARFLYSFLKDFAAPRILEEDLIFRMVFSITPSHAGSFCLTDDVTTEDGRAVAHGNPMQEFPHGAFHANEKFGFELVFTAPTHAGMQNQNFKHSYAVALCLDFDALPEGSRNPSYRFNEVWVERKAFPRAGPLRSLITVGLFDDADDLDRQ

SEQ ID NO: 44 - protein, 237 aa, Artificial Sequence
  Coat protein of Potato Virus x
MTTPANTTQATGSTTSTTTKTAGATPATTSGLFTIPDGEFFSTARAIVASNAVATNEDLSKIEAIWKDMKVPTDTMAQAAWDLVRHCADVGSSAQTEMIDTGPYSNGISRARLAAAIKEVCTLRQFCMKYAPVVWNWMLTNNSPPANWQAQGFKPEHKFAAFDFFNGVTNPAAIMPKEGLIRPPSEAEMNAAQTAAFVKITKARAQSNDFASLDAAVTRGRITGTTTAEAVVTLPPP

SEQ ID NO: 45 - protein, 395 aa, Artificial Sequence
  Class I OMP
MRKKLTALVLSALPLAAVADVSLYGEIKAGVEGRNYQLQLTEAQAANGGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 46 - protein, 347 aa, Artificial Sequence
  Fimbullin
MVLKTSNSNRAFGVGDDESKVAKLTVMVYNGEQQEAIKSAENATKVEDIKCSAGQRTLVVMANTGAMELVGKTLAEVKALTTELTAENQEAAGLIMTAEPKTIVLKAGKNYIGYSGTGEGNHIENDPLKIKRVHARMAFTEIKVQMSAAYDNIYTFVPEKIYGLIAKKQSNLFGATLVNADANYLTGSLTTFNGAYTPANYANVPWLSRNYVAPAADAPQGFYVLENDYSANGGTIHPTILCVYGKLQKNGADLAGADLAAAQAANWVDAEGKTYYPVLVNFNSNNYTYDSNYTPKNKIERNHKYDIKLTITGPGTNNPENPITESAHLNVQCTVAEWVLVGQNATW

SEQ ID NO: 47 - protein, 428 aa, Artificial Sequence
  MALP-2
MKKSKKILLGLSPIAAVLPAVAVSCGNNDESNISFKEKDISKYTTTNANGKQVVKNAELLKLKPVLITDEGKIDDKSFNQSAFEALKAINKQTGIEINSVEPSSNFESAYNSALSAGHKIWVLNGFKHQQSIKQYIDAHREELERNQIKIIGIDFDIETEYKWFYSLQFNIKESAFTTGYAIASWLSEQDESKRVVASFGVGAFPGVTTFNEGFAKGILYYNQKHKSSKIYHTSPVKLDSGFTAGEKMNTVINNVLSSTPADVKYNPHVILSVAGPATFETVRLANKGQYVIGVDSDQGMIQDKDRILTSVLKHIKQAVYETLLDLILEKEEGYKPYVVKDKKADKKWSHFGTQKEKWIGVAENHFSNTEEQAKINNKIKEAIKMFKELPEDFVKYINSDKALKDGNKIDNVSERLEAIISAINKAAK

SEQ ID NO: 48 - protein, 143 aa, Artificial Sequence
  p19
ATTLPVQRHPRSLFPEFSELFAAFPSFAGLRPTFDTRLMRLEDEMKEGRYEVRAELPGVDPDKDVDIMVRDGQLTIKAERTEQKDFDGRSEFAYGSFVRTVSLPVGADEDDIKATYDKGILTVSVAVSEGKPTEKHIQIRSTN

SEQ ID NO: 49 - protein, 5 aa, Artificial Sequence
  VARIANT 2, 4: Xaa = Any Amino Acid
  CR2 homology region
LXCXE

SEQ ID NO: 50 - protein, 4 aa, Artificial Sequence
  VARIANT 2, 3: Xaa = Any Amino Acid
  Zinc binding sequence
CXXC

SEQ ID NO: 51 - protein, 158 aa, Artificial Sequence
  HPV16 E6
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 52 - protein, 140 aa, Artificial Sequence
  HPV1 E6 GenBank Accession No: NP_040305
MATPIRTVRQLSESLCIPYIDVLLPCNFCNYFLSNAEKLLFDHFDLHLVWRDNLVFGCCQGCARTVSLLEFVLYYQESYEVPEIEEILDRPLLQIELRCVTCIKKLSVAEKLEVVSNGERVHRVRNRLKAKCSLCRLYAI

SEQ ID NO: 53 - DNA, 420 bp, Artificial Sequence
  HPV1 E6
atggcgacaccaatccggaccgtcagacagctttccgaaagcctctgtatcccatatattgatgttttattgccttgtaatttttgtaattattttttgtctaatgctgagaagctgctttttgatcattttgatttgcatcttgtctggagagacaatttggtgtttggatgctgtcaagggtgtgctagaactgttagcctattggagtttgttttatattatcaggagtcttatgaggtaccggaaatagaagaaattttggacagacctttattgcaaattgaactccgttgtgttacatgcataaaaaaactgagtgttgctgaaaaattggaggttgtgtcaaacggagaaagagtgcatagagttagaaacagacttaaagcaaagtgtagtttgtgtcgcttgtatgctata

SEQ ID NO: 54 - protein, 159 aa, Artificial Sequence
  HPV2 E6 GenBank Accession No: AB014920
MHTRAGMSEENPCPRNIFLLCKEYGLELEDLRLLCVWCKRPLSEADIWAFAIKELFVVWRKGFPFGACGKCLIAAGKLRQYRHWHYSCYGDTVETETGIPIPQLFMRCYICHKPLSWEEKEALLVGNKRFHNISGRWTGHCMNCGSSCTATDPASRTLH

SEQ ID NO: 55 - DNA, 477 bp, Artificial Sequence
  HPV2 E6
atgcacacaagggcagggatgtctgaggagaatccatgccctaggaacatctttttgctttgcaaagagtatggtttggagctagaggatttgcgattgctctgtgtatggtgcaaacggccgttatcagaggctgacatatgggcatttgcaataaaagaactgtttgtagtgtggagaaagggcttcccatttggagcctgcggaaaatgcctgattgcagcaggaaaacttagacaatacagacattggcattactcatgctacggagacacagtggagactgagacaggaatacccatacctcagctgtttatgagatgctatatttgccataagcccctgagctgggaggagaaggaggcattactagttggaaacaagcgtttccacaacatatcaggccggtggacgggacattgcatgaactgtgggtcatcatgcacggcaaccgacccagcctcaaggacattacac

SEQ ID NO: 56 - protein, 157 aa, Artificial Sequence
  HPV5 E6 GenBank Accession No: BAA42817
MAEGAEHQQKLTEKDKAELPSTIRDLAETLGIPLIDCIIPCNFCGKFLNYLEACEFDYKKLSLIWKDYCVFACCRVCCGATATYEFNQFYEQTVLGRDIELASGLSIFDIDIRCQTCLAFLDIIEKLDCCGRGLPFHKVRNAWKGICRQCKHFYHDW

SEQ ID NO: 57 - DNA, 471 bp, Artificial Sequence
  HPV5 E6
atggctgagggagccgaacaccaacagaaactgacagaaaaagataaggcagaattaccttcaaccattagagacttagctgaaaccttaggcatccctcttattgattgtataataccttgcaatttttgtggtaaatttttaaattatttggaagcctgtgaattcgactacaaaaaacttagcctaatttggaaagattattgtgtgtttgcgtgttgtcgcgtatgctgtggcgccactgcaacatacgaatttaatcaattttatgagcagacagtgttaggaagagatattgagttagcttcaggactctcgatttttgatattgatatcaggtgtcaaacttgcttagcatttcttgacattatagaaaagttagattgctgtggcagaggccttccctttcacaaggtgaggaacgcctggaagggaatctgtaggcagtgtaagcatttttatcatgattgg

SEQ ID NO: 58 - protein, 150 aa, Artificial Sequence
  HPV6 E6 GenBank Accession No: AAF00064
MESANASTSATTIDQLCKTFNLSMHTLQINCVFCKNALTTAEIYSYAYKQLKVLFRGGYPYAACACCLEFHGKINQYRHFDYAGYATTVEEETKQDILDVLIRCYLCHKPLCEVEKVKHILTKARFIKLNCTWKGRCLHCWTTCMEDMLP

SEQ ID NO: 59 - DNA, 450 bp, Artificial Sequence
  HPV6 E6
atggaaagtgcaaatgcctccacgtctgcaacgaccatagaccagttgtgcaagacgtttaatctatctatgcatacgttgcaaattaattgtgtgttttgcaagaatgcactgaccactgcagagatttattcatatgcatataaacagctaaaggtcctgtttcgaggcggctatccatatgcagcctgcgcgtgctgcctagaatttcatggaaaaattaaccaatatagacactttgattatgctggatatgcaacaactgttgaagaagaaactaaacaagacattttagacgtgctaattcggtgctacctgtgtcacaaaccgctgtgtgaagtagaaaaggtaaaacatatactaaccaaggcacggttcataaagctaaattgtacgtggaagggtcgctgcctacactgctggacaacatgcatggaagacatgttaccc

SEQ ID NO: 60 - protein, 120 aa, Artificial Sequence
  HPV8 E6 GenBank Accession No: AAD47251
STIKELAEALGIPLQDCLVPCNFCGNFFDFLELCEFDKKRLCLIWKNYVVTACCRCCCVATATFEFNEYYEQTVLGRDIELATGRSIFEIDVRCQNCLSFLDIIEKLDCCGRGRPFHKVR

SEQ ID NO: 61 - DNA, 361 bp, Artificial Sequence
  HPV8 E6
tctactattaaagagttagctgaggcattaggtattccactgcaggactgtttagtaccttgcaacttttgtggtaactttttcgatttcttagaactgtgtgagtttgacaaaaagagactgtgcctaatttggaaaaattacgttgttactgcgtgttgtcgttgttgttgtgtagcaaccgcaacgtttgaatttaatgaatattatgagcaaactgtgctaggcagagatattgaattagctacaggacgttcaatttttgagatagacgttaggtgtcaaaactgcttgtcatttttggatatcatagagaaattagattgctgtgggagaggccgtccctttcataaagttagag

SEQ ID NO: 62 - protein, 150 aa, Artificial Sequence
  HPV11 E6 GenBank Accession No: P04019
MESKDASTSATSIDQLCKTFNLSLHTLQIQCVFCRNALTTAEIYAYAYKNLKVVWRDNFPFAACACCLELQGKINQYRHFNYAAYAPTVEEETNEDILKVLIRCYLCHKPLCEIEKLKHILGKARFIKLNNQWKGRCLHCWTTCMEDLLP

SEQ ID NO: 63 - DNA, 450 bp, Artificial Sequence
  HPV11 E6
atggaaagtaaagatgcctccacgtctgcaacatctatagaccagttgtgcaagacgtttaatctttctttgcacactctgcaaattcagtgcgtgttttgcaggaatgcactgaccaccgcagagatatatgcatatgcctataagaacctaaaggttgtgtggcgagacaactttccctttgcagcgtgtgcctgttgcttagaactgcaagggaaaattaaccaatatagacactttaattatgctgcatatgcacctacagtagaagaagaaaccaatgaagatattttaaaagtgttaattcgttgttacctgtgtcacaagccgttgtgtgaaatagaaaaactaaagcacatattgggaaaggcacgcttcataaaactaaataaccagtggaagggtcgttgcttacactgctggacaacatgcatggaagacttgttaccc

SEQ ID NO: 64 - protein, 158 aa, Artificial Sequence
  HPV18 E6 GenBank Accession No: CAA00542
MARFEDPTRRPYKLPDLCTELSTSLQDIEITCVYCKTVLELTEVFEFAFKDLFVVYRDSIPHAACHKCIDFYSRIRELRHYSDSVYGDTLEKLTNTGLYNLLIRCLRCQKPLNPAEKLRHLNEKRRFHNIAGHYRGQCHSCCNRARQERLQRRRETQV

SEQ ID NO: 65 - DNA, 474 bp, Artificial Sequence
  HPV18 E6
atggcgcgctttgaggatccaacacggcgaccctacaagctacctgatctgtgcacggaactgagcacttcactgcaagacatagaaataacctgtgtatattgcaagacagtattggaacttacagaggtatttgaatttgcatttaaagatttatttgtggtgtatagagacagtataccgcatgctgcatgccataaatgtatagatttttattctagaattagagaattaagacattattcagactctgtgtatggagacacattggaaaaactaactaacactgggttatacaatttattaataaggtgcctgcggtgccagaaaccgttgaatccagcagaaaaacttagacaccttaatgaaaaacgacgatttcacaacatagctgggcactatagaggccagtgccattcgtgctgcaaccgagcacgacaggaaagactccaacgacgcagagaaacacaagta

SEQ ID NO: 66 - protein, 98 aa, Artificial Sequence
  HPV16 E7
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 67 - protein, 93 aa, Artificial Sequence
  HPV1 E7 GenBank Accession No: NP_040307
MVGEMPALKDLVLQLEPSVLDLDLYCYEEVPPDDIEEELVSPQQPYAVVASCAYCEKLVRLTVLADHSAIRQLEELLLRSLNIVCPLCTLQRQ

SEQ ID NO: 68 - DNA, 279 bp, Artificial Sequence
  HPV1 E7
atggtgggcgaaatgccagcactaaaggacctggttcttcaacttgaaccaagcgtcctagatttagatctttattgttacgaggaggtgcctcctgatgacatagaggaggagttagtgtcgcctcagcaaccttatgctgtcgttgcttcctgtgcctattgcgagaaactggttcgattgaccgtcctcgcggatcacagcgccattagacagctggaggaactccttctgcgatctttgaacatcgtgtgcccactgtgcaccctacagcgacag

SEQ ID NO: 69 - protein, 92 aa, Artificial Sequence
  HPV2 E7 GenBank Accession No: AB014921
MHGNRPSLKDITLILDEIPEIVDLHCDEQFDSSEEENNHQLTEPDVQAYGVVTTCCKCGRTVRLVVECGQADLRELEQLFLKTLTLVCPHCA

SEQ ID NO: 70 - DNA, 276 bp, Artificial Sequence
  HPV2 E7
atgcacggcaaccgacccagcctcaaggacattacactaatattggatgaaatacccgaaattgttgacctacattgcgacgagcaatttgacagctcagaagaagaaaataaccatcaactgacagaaccagatgtgcaggcctacggggtggtaactacctgctgtaagtgtggcagaaccgtccggctggtggttgagtgcggacaagcagacctaagagagctggaacagctgttcttgaagacgctgactctagtgtgccctcactgcgcc

SEQ ID NO: 71 - protein, 103 aa, Artificial Sequence
  HPV5 E7  GenBank Accession No: CAA52694
MIGKEVTVQDIILELSEVQPEVLPVDLFCEEELPNEQETEEEPDIERISYKVIAPCGCRHCEVKLRIFVHATEFGIRAFQQLLTGDLQLLCPDCRGNCKHDGS

SEQ ID NO: 72 - DNA, 309 bp, Artificial Sequence
  HPV5 E7
atgattggtaaagaggtcaccgtgcaagatattattctggagctcagtgaggtgcagcccgaagtgctaccagttgacctgttttgtgaagaggaattaccaaacgagcaggaaacggaggaggagcctgacatcgaaaggatctcttacaaagttatagctccgtgcggttgcaggcactgtgaggtcaagcttcgcatttttgtccacgccacagaatttggtattagagctttccaacagctattgaccggagatctgcagctcctgtgtcctgactgtcgcggaaactgcaaacatgacggatcc

SEQ ID NO: 73 - protein, 98 aa, Artificial Sequence
  HPV6 E7 GenBank Accession No: AAF00065
MHGRHVTLKDIVLDLQPPDPVGLHCYEQLVDSSEDEVDEVDGQDSQPLKQHYQIVTCCCGCDSNVRLVVQCTETDIREVQQLLLGTLNIVCPICAPKT

SEQ ID NO: 74 - DNA, 294 bp, Artificial Sequence
  HPV6 E7
atgcatggaagacatgttaccctaaaggatattgtattagacctgcaacctccagaccctgtagggttacattgctatgagcaattagtagacagctcagaagatgaggtggacgaagtggacggacaagattcacaacctttaaaacaacattaccaaatagtgacctgttgctgtggatgtgacagcaacgttcgactggttgtgcagtgtacagaaacagacatcagagaagtgcaacagcttctgttgggaacactaaacatagtgtgtcccatctgcgcaccgaagaca

SEQ ID NO: 75 - protein, 103 aa, Artificial Sequence
  HPV8 E7 GenBank Accession No: P064
MIGKEVTVQDFVLKLSEIQPEVLPVDLLCEEELPNEQETEEELDIERTVFKIVAPCGCSCCQVKLRLFVNATDSGIRTFQELLFRDLQLLCPECRGNCKHGGS

SEQ ID NO: 76 - protein, 98 aa, Artificial Sequence
  HPV11 E7 GenBank Accession No: P04020
MHGRLVTLKDIVLDLQPPDPVGLHCYEQLEDSSEDEVDKVDKQDAQPLTQHYQILTCCCGCDSNVRLVVECTDGDIRQLQDLLLGTLNIVCPICAPKP

SEQ ID NO: 77 - DNA, 294 bp, Artificial Sequence
  HPV11 E7
atgcatggaagacttgttaccctaaaggatatagtactagacctgcagcctcctgaccctgtagggttacattgctatgagcaattagaagacagctcagaagatgaggtggacaaggtggacaaacaagacgcacaacctttaacacaacattaccaaatactgacctgttgctgtggatgtgacagcaacgtccgactggttgtggagtgcacagacggagacatcagacaactacaagaccttttgctgggcacactaaatattgtgtgtcccatctgcgcaccaaaacca

SEQ ID NO: 78 - protein, 105 aa, Artificial Sequence
  HPV18 E7 GenBank Accession No: CAA00543
MHGPKATLQDIVLHLEPQNEIPVDLLCHEQLSDSEEENDEIDGVNHQHLPARRAEPQRHTMLCMCCKCEARIKLVVESSADDLRAFQQLFLNTLSFVCPWCASQQ

SEQ ID NO: 79 - DNA, 315 bp, Artificial Sequence
  HPV18 E7
atgcatggacctaaggcaacattgcaagacattgtattgcatttagagccccaaaatgaaattccggttgaccttctatgtcacgagcaattaagcgactcagaggaagaaaacgatgaaatagatggagttaatcatcaacatttaccagcccgacgagctgaaccacaacgtcacacaatgttgtgtatgtgttgtaagtgtgaagccagaattaagctagtagtagaaagctcagcagacgaccttcgagcattccagcagctgtttctgaacaccctgtcctttgtgtgtccgtggtgtgcatcccagcag

SEQ ID NO: 80 - protein, 473 aa, Artificial Sequence
  HPV16 L2
MRHKRSAKRTKRASATQLYKTCKQAGTCPPDIIPKVEGKTIADQILQYGSMGVFFGGLGIGTGSGTGGRTGYIPLGTRPPTATDTLAPVRPPLTVDPVGPSDPSIVSLVEETSFIDAGAPTSVPSIPPDVSGFSITTSTDTTPAILDINNTVTTVTTHNNPTFTDPSVLQPPTPAETGGHFTLSSSTISTHNYEEIPMDTFIVSTNPNTVTSSTPIPGSRPVARLGLYSRTTQQVKVVDPAFVTTPTKLITYDNPAYEGIDVDNTLYFSSNDNSINIAPDPDFLDIVALHRPALTSRRTGIRYSRIGNKQTLRTRSGKSIGAKVHYYYDFSTIDPAEEIELQTITPSTYTTTSHAASPTSINNGLYDIYADDFITDTSTTPVPSVPSTSLSGYIPANTTIPFGGAYNIPLVSGPDIPINITDQAPSLIPIVPGSPQYTIIADAGDFYLHPSYYMLRKRRKRLPYFFSDVSLAA

SEQ ID NO: 81 - protein, 234 aa, Artificial Sequence
  HPV1 L2 GenBank Accession No: CAA00832
MVTFDNPAFEPELDEVSIIFQRDLDALAQTPVPEFRDVVYLSKPTFSREPGGRLRVSRLGKSSTIRTRLGTAIGARTHFFYDLSSIAPEDSIELLPLGEHSQTTVISSNLGDTAFIQGETAEDDLEVISLETPQLYSEEELLDTNESVGENLQLTITNSEGEVSILDLTQSRVRPPFGTEDTSLHVYYPNSSKGTPIINPEESFTPLVIIALNNSTGDFELHPSLRKRRKRAYV

SEQ ID NO: 82 - DNA, 702 bp, Artificial Sequence
  HPV1 L2
atggtcacttttgataatccagcatttgagccagagcttgatgaggtgtctattatcttccaaagagacttagatgctcttgctcagacaccagtgcctgaatttagagatgtagtttatctgagcaagcccacattttcgcgggaaccagggggacggttaagggttagccgccttggcaaaagttcaactattcgtacacgcctgggcacagcaattggcgccagaacccactttttctatgatttaagttctattgctccagaagactcaattgaattattgcctttaggtgagcatagtcaaacaacagtcattagttccaacttaggtgacacagcatttatacaaggtgagacagcagaggatgacttagaagttatctctttagaaacaccacaattatattcagaagaagagcttttagacacaaacgaaagtgtgggcgaaaatttgcaacttactattactaactcagagggtgaggtttctatactagatttaacacaaagcagagtcaggccaccttttggcactgaagatactagcttgcatgtatattacccaaattcttctaaagggactccaataattaatcctgaagaatcatttacacctttggttattatagctcttaacaactcaacaggggattttgagttacatcctagtcttagaaagcgtcgtaaaagagcttatgta

SEQ ID NO: 83 - protein, 468 aa, Artificial Sequence
  HPV2 L2 GenBank Accession No: AAY86489
MSIRAKRRKRASPTDLYRTCKQAGTCPPDIIPRVEQNTLADKLLKWGSLGVFFGGLGIGTGSGTGGRTGYIPVGSRPTTVVDIGPTPRPPVIIEPVGASEPSIVTLVEDSSIINAGASHPTFTGTGGFEVTTSTVTDPAVLDITPSGTSVQVSSSSFLNPLYTEPAIVEAPQTGEVSGHVLVSTATSGSHGYEEIPMQTFATSGGSGTEPISSTPLPGVRRVAGPRLYSRANQQVQVRDPAFLARPADLVTFDNPVYDPEETIIFQHPDLHEPPDPDFLDIVALHRPALTSRRGTVRFSRLGRRATLRTRSGKQIGARVHFYHDISPIGTEELEMEPLLPPASTDNTDMLYDVYADSDVLQPLLDELPAAPRGSLSLADTAVSATSASTLRGSTTVPLSSGIDVPVYTGPDIEPPNVPGMGPLIPVAPSLPSSVYIFGGDYYLMPSYVLWPKRRKRVHYFFADGFVAA

SEQ ID NO: 84 - DNA, 1404 bp, Artificial Sequence
  HPV2 L2
atgtctatacgtgccaagcgtcggaagcgcgcctcccccacagacctctatcgtacctgcaagcaggcaggtacctgccccccagacattatcccaagagtggaacagaacactttagcagataaactccttaagtggggcagtttaggtgtgttttttgggggtctaggtataggcaccggcagcggcacaggggggcgtactgggtacattcctgtaggttcgcgacccaccactgtagttgacattggtccaacgcccaggccgcctgttatcattgaacctgtgggggcctctgaaccctctattgtcactttggtggaggactctagcatcattaacgcaggagcttcacatcccacctttactggtactggtggcttcgaagtgacaacctccaccgttacagaccccgccgtcttggatatcaccccctcaggtaccagtgtgcaggtcagcagcagtagctttcttaacccactatacactgagccagctattgtggaggctccccaaacaggggaagtatctggccatgtacttgttagtacagccacctcagggtctcatggctatgaggaaataccaatgcagacgtttgccacgtcggggggcagcggtacagagcctatcagtagcacacccctccctggcgtgcggagagttgccggaccccgcctgtacagtagagccaatcagcaagtgcaagtcagggatcctgcgtttcttgcaaggcctgctgatctagtaacatttgacaatcctgtgtatgacccagaggaaactataatatttcagcatccagacttgcatgagccaccggatcctgattttttggacatagtggcgttgcatcgtcccgccctcacgtccagaaggggtactgtccgttttagtaggttgggacgcagggctacactccgcacccgtagtggtaaacaaattggggcacgggtgcacttctatcatgatattagccctataggtactgaggagttggagatggagccactgttgcccccagcttctactgataacacagatatgttatatgatgtttatgctgattcggatgtccttcagccattgcttgatgagttacccgccgcccctcgcggttcactctctctggctgacactgctgtgtctgccacctccgcatctacactacgggggtccactactgtccctttatcaagtggtattgatgtgcctgtgtacactggtcctgacattgaaccacccaatgttcctggcatgggacctctgattcctgtggctccatccttaccatcgtctgtgtacatatttgggggagattattatttgatgccaagttatgtcttgtggcctaaacgacgtaaacgtgtccactatttctttgcagatggctttgtggcggcc

SEQ ID NO: 85 - protein, 518 aa, Artificial Sequence
  HPV5 L2 GenBank Accession No: AAY86491
MARAKRVKRDSVTHIYQTCKQAGTCPPDVINKVEQTTVADNILKYGSAGVFFGGLGISTGRGTGGATGYVPLGEGPGVRVGGTPTVVRPSLVPETIGPVDILPIDTVNPVEPTASSVVPLTESTGADLLPGEVETIAEIHPVPEGPSVDTPVVTTSTGSSAVLEVAPEPIPPTRVRVSRTQYHNPSFQIITESTPAQGESSLADHVLVTSGSGGQRIGGDITDIIELEEIPSRYTFEIEEPTPPRRSSTPLPRNQSVGRRRGFSLTNRRLVQQVQVDNPLFLTQPSKLVRFAFDNPVFEEEVTNIFENDLDVFEEPPDRDFLDVRELGRPQYSTTPAGYVRVSRLGTRATIRTRSGAQIGSQVHFYRDLSSINTEDPIELQLLGQHSGDATIVQGPVESTFIDMDISENPLSESIEAYSHDLLLDETVEDFSGSQLVIGNRRSTNSYTVPRFETTRNGSYYTQDTKGYYVAYPESRNNAEIIYPTPDIPVVIIHPHDSTGDFYLHPSLRRRKRKRKYL

SEQ ID NO: 86 - DNA, 1554 bp, Artificial Sequence
  HPV5 L2
atggcgcgtgcaaaaagggtcaagcgagactctgtaactcatatttaccaaacctgcaaacaggcaggcacttgcccccctgatgttattaataaagtggaacaaacaacagttgctgacaatattttaaaatatggcagtgctggtgtattttttggtggccttggtattagtacaggccgaggaactgggggtgctacagggtacgtgccacttggggaaggtcctggtgtccgtgtcggaggaacccccacggttgtaaggccttccttggttcctgaaacaatcgggcccgttgatattttgcccattgatacagttaaccccgtggaacctacagcatcatccgtggtccctctaactgagtccacaggcgctgatttacttccaggtgaagtagaaacaattgctgaaatccatcctgtacctgaggggccatcagtggatacccctgtagttaccactagcacaggttccagtgctgttttagaggttgccccagagcctattcctccaacacgggtcagggtttcacgcacacagtatcacaatccatcttttcaaataataactgagtctactccagcacaaggggaatcgtctcttgcagatcacgttttggtgacatcgggttctggggggcaacgaatagggggtgatataactgacataattgagttagaggaaattcctagtaggtatacatttgaaattgaagaaccaactcctccacgccgcagcagtactccattgccacgcaatcaatctgtaggccgtaggaggggtttctctttgactaatagacgtttagtacagcaggtacaagtggacaatccattgtttctaactcaaccatctaagttagttcgttttgcatttgataatcctgtttttgaggaagaagtgactaatatatttgaaaatgatctggatgtctttgaagaacctccagacagagattttcttgatgttagggaattgggacgtccacaatattctacaacaccagcgggatatgttagagtaagcaggttggggactcgagccactattcgcactcgctctggtgcacagatagggtcgcaagtccatttttacagagatcttagctctattaatactgaagatcctattgaattacaattattaggccaacattcaggtgatgctactatagtccagggacctgttgaaagcacatttatagatatggatatttctgaaaatccattatctgaaagcattgaagcatattcacatgatttattattagatgaaacggtggaagatttcagtgggtctcagctggttataggtaatcgaaggagcacaaactcttacactgttcctaggtttgaaactacaagaaatggttcatactatacacaagacacaaagggatattatgttgcatatccagagtcacgtaataatgcagaaatcatttatcctacacctgatattcctgtagtcattatacaccctcatgacagtacaggggacttttatttacatcccagtcttcgcaggcgcaaacgtaaaagaaaatatttg

SEQ ID NO: 87 - protein, 459 aa, Artificial Sequence
  HPV6 L2 GenBank Accession No: AAF00067
MAHSRARRRKRASATQLYQTCKLTGTCPPDVIPKVEHNTIADQILKWGSLGVFFGGLGIGTGSGTGGRTGYVPLGTSAKPSITSGPMARPPVVVEPVAPSDPSIVSLIEESAIINAGAPEIVPPAHGGFTITSSETTTPAILDVSVTSHTTTSIFRNPVFTEPSVTQPQPPVEANGHILISAPTITSHPIEEIPLDTFVISSSDSGPTSSTPVPGTAPRPRVGLYSRALHQVQVTDPAFLSTPQRLITYDNPVYEGEDVSVQFSHDSIHNAPDEAFMDIIRLHRPAIASRRGLVRYSRIGQRGSMHTRSGKHIGARIHYFYDISPIAQAAEEIEMHPLVAAQEDTFDIYAESFEPDINPTQHPVTNISDTYLTSTPNTVTQPWGNTTVPLSIPNDLFLQSGPDITFPTAPMGTPFSPVTPALPTGPVFITGSGFYLHPAWYFARKRRKRIPLFFSDVAA

SEQ ID NO: 88 - DNA, 1377 bp, Artificial Sequence
  HPV6 L2
atggcacatagtagggcccgacgacgcaagcgtgcgtcagctacacagctatatcaaacatgtaaactcactggaacatgccccccagatgtaattcctaaggtggaacacaacaccattgcagatcaaatattaaaatgggggagtttgggggtgttttttggagggttgggtataggcaccggttccggcactgggggtcgtactggctatgttcccttaggaacttctgcaaaaccttctattactagtgggcctatggctcgtcctcctgtggtggtggagcctgtggccccttcggatccatccattgtgtctttaattgaagaatcggcaatcattaacgcaggggcgcctgaaattgtgccccctgcacacggtgggtttacaattacatcctctgaaacaactacccctgcaatattggatgtatcagttactagtcatactactactagtatatttagaaatcctgtctttacagaaccttctgtaacacaaccccaaccacccgtggaggctaatggacatatattaatttctgcacccactataacgtcacaccctatagaggaaattcctttagatacttttgtgatatcctctagtgatagcggtcctacatccagtacccctgttcctggtactgcacctcggcctcgtgtgggcctatatagtcgtgcattgcaccaggtgcaggttacagaccctgcatttctttccactcctcaacgcttaattacatatgataaccctgtatatgaaggggaggatgttagtgtacaatttagtcatgattctatacacaatgcacctgatgaggcttttatggacataattcgtttgcacagacctgctattgcgtcccgacgtggccttgtgcggtacagtcgcattggacaacgggggtctatgcacactcgcagcggaaagcacataggggcccgcattcattatttttatgatatttcacctattgcacaagctgcagaagaaatagaaatgcaccctcttgtggctgcacaggaagatacatttgatatttatgctgaatcttttgaacctgacattaaccctacccaacaccctgttacaaatatatcagatacatatttaacttccacacctaatacagttacacaaccgtggggtaacaccacagttccattgtcaattcctaatgacctgtttttacagtctggccctgatataacttttcctactgcacctatgggaacaccctttagtcctgtaactcctgctttacctacaggccctgttttcattacaggttctggattttatttgcatcctgcatggtattttgcacgtaaacgccgtaaacgtattcccttatttttttcagatgtggcggcc

SEQ ID NO: 89 - protein, 518 aa, Artificial Sequence
  HPV8 L2 GenBank Accession No: P06419
MARARRVKRDSVTHIYQTCKQAGTCPPDVINKVEQTTVADNILKYGSAGVFFGGLGIGTGRGTGGVTGYTPLSEGPGIRVGNTPTVVRPSLVPEAVGPMDILPIDTIDPVEPSVSSVVPLTESSGADLLPGEVETIAEIHPVPEGPTIDSPVVTTSKGSSAILEVAPEPTPPTRVRVSRTQYHNPSFQIITDSTPTQGESSLADHILVTSGSGGQTIGSDITDVIELQEFPSRYSFEIDEPTPPRQSSTPIERPQVVGRRRGISLTNRRLIQQVAVEDPLFLSKPSKLVRFSFDNPVFEEEVTNIFEQDVDMVEEPPDRDFLDVRQLGRPQYSTTPAGYVRVSRLGTRGTIRTRSGAQIGSQVHFYRDLSSINTEDPIELQLLGQHSGDSTIVQGPVESTFVNVDISENPLSESIQAFSDDLLLDETVEDFSGSQLVIGNRRSTTSYTVPRFETTRSGSYYVQDTKGYYVAYPESRNNEEIIYPTPDLPVVIIHTHDNSGDFFLHPSLRRRKRKRKYL

SEQ ID NO: 90 - protein, 455 aa, Artificial Sequence
  HPV11 L2 GenBank Accession No: P04013
MKPRARRRKRASATQLYQTCKATGTCPPDVIPKVEHTTIADQILKWGSLGVFFGGLGIGTGAGSGGRAGYIPLGSSPKPAITGGPAARPPVLVEPVAPSDPSIVSLIEESAIINAGAPEVVPPTQGGFTITSSESTTPAILDVSVTNHTTTSVFQNPLFTEPSVIQPQPPVEASGHILISAPTITSQHVEDIPLDTFVVSSSDSGPTSSTPLPRAFPRPRVGLYSRALQQVQVTDPAFLSTPQRLVTYDNPVYEGEDVSLQFTHESIHNAPDEAFMDIIRLHRPAITSRRGLVRFSRIGQRGSMYTRSGQHIGARIHYFQDISPVTQAAEEIELHPLVAAENDTFDIYAEPFDPIPDPVQHSVTQSYLTSTPNTLSQSWGNTTVPLSIPSDWFVQSGPDITFPTASMGTPFSPVTPALPTGPVFITGSDFYLHPTWYFARRRRKRIPLFFTDVAA

SEQ ID NO: 91 - DNA, 1365 bp, Artificial Sequence
  HPV11 L2
atgaaacctagggcacgcagacgtaaacgtgcgtcagccacacaactatatcaaacatgcaaggccactggtacatgtcccccagatgtaattcctaaagttgaacatactactattgcagatcaaatattaaaatggggaagcttaggggttttttttggtgggttaggtattggtacaggggctggtagtggcggtcgtgcagggtatatacccttgggaagctctcccaagcctgctattactggggggccagcagcacgtccgccagtgcttgtggagcctgttgccccttccgatccctccattgtgtccttaattgaggagtctgctattattaatgctggtgcacctgaggtggtaccccctacacagggtggctttactataacatcatctgaatcgactacacctgctattttagatgtgtctgttaccaatcacactaccactagtgtgtttcaaaatcccctgtttacagaaccgtctgtaatacagccccaaccacctgtggaggccagtggtcacatacttatatctgccccaacaataacatcccaacatgtagaagacattccactagacacttttgttgtatcctctagtgatagtggacctacatccagtactcctcttcctcgtgcttttcctcggcctcgggtgggtttgtatagtcgtgccttacagcaggtacaggttacggaccccgcgtttttgtccacgccacagcgattggtaacttatgacaaccctgtctatgaaggagaagatgtaagtttacaatttacccatgagtctatccacaatgcacctgatgaagcatttatggatattattagactacatagaccagctataacgtccagacggggtcttgtgcgttttagtcgcattgggcaacgggggtccatgtacacacgcagtggacaacatataggtgcccgcatacattattttcaggacatttcaccagttacacaagctgcagaggaaatagaactgcaccctctagtggctgcagaaaatgacacgtttgatatttatgctgaaccatttgaccctatccctgaccctgtccaacattctgttacacagtcttatcttacctccacacctaataccctttcacaatcgtggggtaataccacagtcccattgtcaatccctagtgactggtttgtgcagtctgggcctgacataacttttcctactgcatctatgggaacaccctttagtcctgtaactcctgctttacctacaggccctgtttttattacaggttctgacttctatttgcatcctacatggtactttgcacgcagacgccgtaaacgtattcccttattttttacagatgtggcggcc

SEQ ID NO: 92 - protein, 462 aa, Artificial Sequence
  HPV18 L2 GenBank Accession No: AAP20600
MVSHRAARRKRASVTDLYKTCKQSGTCPPDVVPKVEGTTLADKILQWSSLGIFLGGLGIGTGSGTGGRTGYIPLGGRSNTVVDVGPTRPPVVIEPVGPTDPSIVTLIEDSSVVTSGAPRPTFTGTSGFDITSAGTTTPAVLDITPSSTSVSISTTNFTNPAFSDPSIIEVPQTGEVAGNVFVGTPTSGTHGYEEIPLQTFASSGTGEEPISSTPLPTVRRVAGPRLYSRAYQQVSVANPEFLTRPSSLITYDNPAFEPVDTTLTFDPRSDVPDSDFMDIIRLHRPALTSRRGTVRFSRLGQRATMFTRSGTQIGARVHFYHDISPIAPSPEYIELQPLVSATEDNDLFDIYADDMDPAVPVPSRSTTSFAFFKYSPTISSASSYSNVTVPLTSSWDVPVYTGPDITLPSTTSVWPIVSPTAPASTQYIGIHGTHYYLWPLYYFIPKKRKRVPYFFADGFVAA

SEQ ID NO: 93 - DNA, 1386 bp, Artificial Sequence
  HPV18 L2
atggtatcccaccgtgccgcacgacgcaaacgggcttcggtaactgacttatataaaacatgtaaacaatctggtacatgtccacctgatgttgttcctaaggtggagggcaccacgttagcagataaaatattgcaatggtcaagccttggtatatttttgggtggacttggcataggtactggcagtggtacagggggtcgtacagggtacattccattgggtgggcgttccaatacagtggtggatgttggtcctacacgtcccccagtggttattgaacctgtgggccccacagacccatctattgttacattaatagaggactccagtgtggttacatcaggtgcacctaggcctacgtttactggcacgtctgggtttgatataacatctgcgggtacaactacacctgcggttttggatatcacaccttcgtctacctctgtgtctatttccacaaccaattttaccaatcctgcattttctgatccgtccattattgaagttccacaaactggggaggtggcaggtaatgtatttgttggtacccctacatctggaacacatgggtatgaggaaatacctttacaaacatttgcttcttctggtacgggggaggaacccattagtagtaccccattgcctactgtgcggcgtgtagcaggtccccgcctttacagtagggcctaccaacaagtgtcagtggctaaccctgagtttcttacacgtccatcctctttaattacatatgacaacccggcctttgagcctgtggacactacattaacatttgatcctcgtagtgatgttcctgattcagattttatggatattatccgtctacataggcctgctttaacatccaggcgtgggactgttcgctttagtagattaggtcaacgggcaactatgtttacccgcagcggtacacaaataggtgctagggttcacttttatcatgatataagtcctattgcaccttccccagaatatattgaactgcagcctttagtatctgccacggaggacaatgacttgtttgatatatatgcagatgacatggaccctgcagtgcctgtaccatcgcgttctactacctcctttgcattttttaaatattcgcccactatatcttctgcctcttcctatagtaatgtaacggtccctttaacctcctcttgggatgtgcctgtatacacgggtcctgatattacattaccatctactacctctgtatggcccattgtatcacccacggcccctgcctctacacagtatattggtatacatggtacacattattatttgtggccattatattattttattcctaagaaacgtaaacgtgttccctatttttttgcagatggctttgtggcggcc

SEQ ID NO: 94 - protein, 494 aa, Artificial Sequence
  HPV2 L1 GenBank Accession No: AAY86490
MALWRPNESKVYLPPTPVSKVISTDVYVTRTNVYYHGGSSRLLTVGHPYYSIKKSNNKVAVPKVSGYQYRVFHVKLPDPNKFGLPDADLYDPDTQRLLWACVGVEVGRGQPLGVGVSGHPYYNRLDDTENAHTPDTADDGRENISMDYKQTQLFILGCKPPIGEHWSKGTTCNGSSAAGDCPPLQFTNTTIEDGDMVETGFGALDFATLQSNKSDVPLDICTNTCKYPDYLKMAAEPYGDSMFFSLRREQMFTRHFFNLGGKMGDTIPDELYIKSTSVPTPGSHVYTSTPSGSMVSSEQQLFNKPYWLRRAQGHNNGMCWGNRVFLTVVDTTRSTNVSLCATEASDTNYKATNFKEYLRHMEEYDLQFIFQLCKITLTPEIMAYIHNMDPQLLEDWNFGVPPPPSASLQDTYRYLQSQAITCQKPTPPKTPTDPYASLTFWDVDLSESFSMDLDQFPLGRKFLLQRGAMPTVSRKRAAVSGTTPPTSKRKRVRR

SEQ ID NO: 95 - DNA, 1482 bp, Artificial Sequence
  HPV2 L1
atggctttgtggcggcctaatgaaagcaaggtatacctacctccaacacctgtttcaaaggtgatcagtacggatgtctatgtcacgcggactaatgtttattaccatggtggcagttctaggcttctcactgtgggtcatccatattactctataaagaagagtaataataaggtggctgtgcccaaggtatctggctaccaatatcgtgtatttcacgtgaagttgccagatcccaataagtttggcctgcccgatgctgatttgtatgatccggatacccagagacttctgtgggcgtgcgtgggagtagaggtgggccgtgggcagcctttgggtgtgggtgtgtctggtcacccatattacaatagactggatgacactgaaaatgcacacacacctgatacagctgatgatggcagggaaaacatttctatggattataaacagacacagctgttcattctgggctgcaaaccccctattggtgagcactggtctaagggtaccacctgtaatgggtcttctgcggctggtgactgcccgcccctccaatttactaacacaactattgaggacggggatatggttgaaacagggttcggtgccttggattttgccactctgcagtcaaataagtcagatgttcctttggatatttgtaccaatacctgtaaatatcctgattatctgaagatggctgcagagccttatggtgattctatgttcttctcgctgcgtagggaacaaatgttcactcgtcattttttcaatctgggtggtaagatgggtgacaccatcccggatgagttatacattaaaagtacctcagttccaactccaggcagtcatgtttatacttccactcctagtggctctatggtgtcctctgaacaacagttgtttaataagccttactggctacggagggcccaagggcacaacaatggtatgtgctggggcaatagggtctttctgactgtggtggacaccacacgtagcactaatgtatctctgtgtgccactgaggcgtctgatactaattataaggctaccaattttaaggaatatctcaggcatatggaggaatatgatttgcagttcatcttccaactgtgcaagataacccttactcctgaaattatggcctatatacataatatggatccccagttgttagaggattggaacttcggtgtaccccctccgccgtctgccagtttacaggatacctatagatatttgcagtcccaggctattacatgtcaaaaacctacacctcctaagacccctaccgatccctatgcctccctgaccttttgggatgtggatctcagtgaaagtttttccatggatctggaccaatttcccttgggtcgcaagtttttgctgcagcggggggctatgcctaccgtgtctcgtaagcgcgccgctgtttcggggaccacgccgcccactagtaaacgaaaacgggtaaggcgt

SEQ ID NO: 96 - protein, 516 aa, Artificial Sequence
  HPV5 L1 GenBank Accession No: AAY86492
MAVWHSANGKVYLPPSTPVARVQSTDEYIQRTNIYYHAFSDRLLTVGHPYFNVYNINGDKLEVPKVSGNQHRVFRLKLPDPNRFALADMSVYNPDKERLVWACRGLEIGRGQPLGVGSTGHPYFNKVKDTENSNAYITFSKDDRQDTSFDPKQIQMFIVGCTPCIGEHWDKAVPCAENDQQTGLCPPIELKNTYIEDGDMADIGFGNMNFKALQDSRSDVSLDIVNETCKYPDFLKMQNDIYGDACFFYARREQCYARHFFVRGGKTGDDIPGAQIDNGTYKNQFYIPGADGQAQKTIGNSMYFPTVSGSLVSSDAQLFNRPFWLQRAQGHNNGILWANQMFITVVDNTRNTNFSISVYNQAGALKDVADYNADQFREYQRHVEEYEISLILQLCKVPLKAEVLAQINAMNSSLLEDWQLGFVPTPDNPIQDTYRYIDSLATRCPDKNPPKEKEDPYKGLHFWDVDLTERLSLDLDQYSLGRKFLFQAGLQQTTVNGTKAVSYKGSNRGTKRKRKN

SEQ ID NO: 97 - DNA, 1548 bp, Artificial Sequence
  HPV5 L1
atggcagtgtggcactcggctaatggtaaagtatatcttccaccatcgacaccggtggccagagtccaaagcaccgatgaatacattcaaagaacaaatatctactatcatgcatttagtgacagattgttaactgtaggtcatccttatttcaatgtatacaatattaatggtgataagcttgaggttcctaaggtttcaggaaatcaacacagagtatttcgcctaaaattaccagatcctaacagatttgcattagctgatatgtctgtttacaaccctgacaaagaacgtttggtttgggcctgtagaggcttagaaataggtaggggccagccattaggtgtagggagtactggtcacccttatttcaataaagtaaaagatacagaaaacagtaatgcatacataacattttctaaagatgacagacaggatacatcttttgatcctaaacagatccaaatgtttattgtaggatgcacaccttgcataggagagcattgggataaagctgttccatgtgcagaaaatgatcagcaaactggcctttgtcctcctattgaactaaaaaacacatatatagaagatggtgatatggcagacataggttttgggaacatgaattttaaggcacttcaagatagtagatcagatgtcagtttagacatcgtcaatgaaacttgcaagtatccagattttttaaagatgcaaaacgatatttatggcgatgcgtgctttttttatgctcgtagggagcaatgttatgccagacacttttttgttagagggggaaaaactggtgatgacattccaggtgcacaaattgacaatggtacatacaaaaatcagttttacattccaggggctgatggccaagctcaaaagactataggaaattccatgtatttcccaactgttagtggctcattagtatccagtgatgctcaattgtttaacaggcccttctggctccaaagagcccaaggtcataataatggcatcctgtgggctaatcaaatgtttatcacagtggttgacaacacaagaaatactaatttcagtatttctgtatataatcaggctggagcactaaaagatgttgcagactataatgcagatcaatttagagaatatcaaagacatgtagaagaatatgaaatatctttaattctacaactctgtaaggttcctttaaaggcagaggtattggcacagatcaatgcaatgaactcttcgttattggaggattggcagttaggatttgttcccactcctgataatccaattcaggacacctacagatatattgactctttggctacacggtgtccagataagaatcctccgaaagaaaaggaagacccttataagggcttacatttttgggatgtagatttaactgaaagattgtcattagatttagatcaatattccttaggcagaaaatttttattccaagctgggttacaacaaacgaccgttaacggtacaaaagcagtgtcttataaagggtctaatagaggaacaaaacgcaaacgtaaaaat

SEQ ID NO: 98 - protein, 500 aa, Artificial Sequence
  HPV6 L1 GenBank Accession No: AAC80445
MWRPSDSTVYVPPPNPVSKVVATDAYVTRTNIFYHASSSRLLAVGHPYFSIKRANKTVVPKVSGYQYRVFKVVLPDPNKFALPDSSLFDPTTQRLVWACTGLEVGRGQPLGVGVSGHPFLNKYDDVENSGSGGNPGQDNRVNVGMDYKQTQLCMVGCAPPLGEHWGKGKQCTNTPVQAGDCPPLELITSVIQDGDMVDTGFGAMNFADLQTNKSDVPIDICGTTCKYPDYLQMAADPYGDRLFFFLRKEQMFARHFFNRAGEVGEPVPDTLIIKGSGNRTSVGSSIYVNTPSGSLVSSEAQLFNKPYWLQKAQGHNNGICWGNQLFVTVVDTTRSTNMTLCASVTTSSTYTNSDYKEYMRHVEEYDLQFIFQLCSITLSAEVMAYIHTMNPSVLEDWNFGLSPPPNGTLEDTYRYVQSQAITCQKPTPEKQKPDPYKNLSFWEVNLKEKFSSELDQYPLGRKFLLQSGYRGRSSIRTGVKRPAVSKASAAPKRKRAKTKR

SEQ ID NO: 99 - DNA, 1500 bp, Artificial Sequence
  HPV6 L1
atgtggcggcctagcgacagcacagtatatgtgcctcctcctaaccctgtatccaaagttgttgccacggatgcttatgttactcgcaccaacatattttatcatgccagcagttctagacttcttgcagtgggtcatccttatttttccataaaacgggctaacaaaactgttgtgccaaaggtgtcaggatatcaatacagggtatttaaggtggtgttaccagatcctaacaaatttgcattgcctgactcgtctctttttgatcccacaacacaacgtttggtatgggcatgcacaggcctagaggtgggcaggggacagccattaggtgtgggtgtaagtggacatcctttcctaaataaatatgatgatgttgaaaattcagggagtggtggtaaccctggacaggataacagggttaatgttggtatggattataaacaaacacaattatgcatggttggatgtgccccccctttgggcgagcattggggtaaaggtaaacagtgtactaatacacctgtacaggctggtgactgcccgcccttagaacttattaccagtgttatacaggatggcgatatggttgacacaggctttggtgctatgaattttgctgatttgcagaccaataaatcagatgttcctattgacatatgtggcactacatgtaaatatccagattatttacaaatggctgcagacccatatggtgatagattatttttttttctacggaaggaacaaatgtttgccagacatttttttaacagggctggcgaggtgggggaacctgtgcctgatactcttataattaagggtagtggaaatcgaacgtctgtagggagtagtatatatgttaacaccccaagcggctctttggtgtcctctgaggcacaattgtttaataagccatattggctacaaaaagcccagggacataacaatggtatttgttggggtaatcaactgtttgttactgtggtagataccacacgcagtaccaacatgacattatgtgcatccgtaactacatcttccacatacaccaattctgattataaagagtacatgcgtcatgtggaagagtatgatttacaatttatttttcaattatgtagcattacattgtctgctgaagtaatggcctatattcacacaatgaatccctctgttttggaagactggaactttgggttatcgcctcccccaaatggtacattagaagatacctataggtatgtgcagtcacaggccattacctgtcaaaagcccactcctgaaaagcaaaagccagatccctataagaaccttagtttttgggaggttaatttaaaagaaaagttttctagtgaattggatcagtatcctttgggacgcaagtttttgttacaaagtggatataggggacggtcctctattcgtaccggtgttaagcgccctgctgtttccaaagcctctgctgcccctaaacgtaagcgcgccaaaactaaaagg

SEQ ID NO: 100 - protein, 514 aa, Artificial Sequence
  HPV8 L1 GenBank Accession No: P06417
MAVWQSATGKVYLPPSTPVARVQSTDEYIQRTNIYYHANTDRLLTVGHPYFNVYNNNGDTLQVPKVSGNQHRVFRLKLPDPNRFALADMSVYNPDKERLVWACRGLEISRGQPLGVGSTGHPYFNKVKDTENSNSYTTTSTDDRQNTSFDPKQIQMFIVGCTPCIGEHWEKAIPCAEDQQQGLCPPIELKNTVIEDGDMADIGFGNMNFKTLQQNRSDVSLDIVNEICKYPDFLKMQNDVYGDACFFYARREQCYARHFFVRGGKTGDDIPAAQIDDGMMKNQYYIPGGQDQSQKDIGNAMYFPTVSGSLVSSDAQLFNRPFWLQRAQGHNNGILWANQMFVTVVDNTRNTNFSISVYTENGELKNITDYKSTQFREYLRHVEEYEISLILQLCKIPLKADVLAQINAMNSSLLEEWQLGFVPTPDTPIHDTYRYIDSLATRCPDKSPPKEKPDPYAKFNFWNVDLTERLSLDLDQYSLGRKFLFQAGLQQTTVNGTKSISRGSVRGTKRKRKN

SEQ ID NO: 101 - protein, 501 aa, Artificial Sequence
  VARIANT 486: Xaa = Any Amino Acid
  HPV11 L1 GenBank Accession No: AAK21269
MWRPSDSTVYVPPPNPVSKVVATDAYVKRTNIFYHASSSRLLAVGHPYYSIKKVNKTVVPKVSGYQYRVFKVVLPDPNKFALPDSSLFDPTTQRLVWACTGLEVGRGQPLGVGVSGHPLLNKYDDVENSGGYGGNPGQDNRVNVGMDYKQTQLCMVGCAPPLGEHWGKGTQCSNTSVQNGDCPPLELITSVIQDGDMVDTGFGAMNFADLQTNKSDVPLDICGTVCKYPDYLQMAADPYGDRLFFYLRKEQMFARHFFNRAGTVGEPVPDDLLVKGGNNRSSVASSIYVHTPSGSLVSSEAQLFNKPYWLQKAQGHNNGICWGNHLFVTVVDTTRSTNMTLCASVSKSATYTNSDYKEYMRHVKEFDLQFIFQLCSITLSAEVMAYIHTMNPSVLEDWNFGLSPPPNGTLEDTYRYVQSQAITCQKPTPEKEKQDPYKDMSFWEVNLKEKFSYELDQFPLGRKFLLQSGYRGRTSARTGIKRPAVXKPSTAPKRKRTKTRK

SEQ ID NO: 102 - protein, 266 aa, Artificial Sequence
  HPV16 L1 GenBank Accession No: AAY57806
NAGVDNRECISMDYKQTQLCLIGCKPPIGEHWGKGSPCTNVAVNPGDCPPLELINTVIQDGDMVDTGFGAMDFTTLQANKSEVPLDICTSICKYPDYIKMVSEPYGDSLFFYLRREQMFVRHLFNRAGAVGENVPDDLYIKGSGSTANLASSNYFPTPSGSMVTSDAQIFNKPYWLQRAQGHNNGICWGNQLFVTVVDTTRSTNMSLCAAISTSETTYKNTNFKEYLRHGEEYDLQFIFQLCKITLTADVMTYIHSMNSTILEDWN

SEQ ID NO: 103 - DNA, 798 bp, Artificial Sequence
  HPV16 L1
aatgcaggtgtggataatagagaatgtatatctatggattacaaacaaacacaattgtgtttaattggttgcaaaccacctataggggaacactggggcaaaggatccccatgtaccaatgttgcagtaaatccaggtgattgtccaccattagagttaataaacacagttattcaggatggtgatatggttgatactggctttggtgctatggactttactacattacaggctaacaaaagtgaagttccactggatatttgtacatctatttgcaaatatccagattatattaaaatggtgtcagaaccatatggcgacagcttatttttttatttacgaagggaacaaatgtttgttagacatttatttaatagggctggtgctgttggtgaaaatgtaccagacgatttatacattaaaggctctgggtctactgcaaatttagccagttcaaattattttcctacacctagtggttctatggttacctctgatgcccaaatattcaataaaccttattggttacaacgagcacagggccacaataatggcatttgttggggtaaccaactatttgttactgttgttgatactacacgcagtacaaatatgtcattatgtgctgccatatctacttcagaaactacatataaaaatactaactttaaggagtacctacgacatggggaggaatatgatttacagtttatttttcaactgtgcaaaataaccttaactgcagacgttatgacatacatacattctatgaattccactattttggaggactggaat

SEQ ID NO: 104 - protein, 535 aa, Artificial Sequence
  HPV18 L1 GenBank Accession No: AAW58852
HYHLLPLYGPLYHPQPLPLHSILVYMVHIIICGHYIILFLKSVNVFPIFLQMALWRPSDNTVYLPPPSVARVVNTDDYVTRTSIFYHAGSSRLLTVGNPYFRVPASGGNKQDIPKVSAYQYRVFRVQLPDPNKFGLPDNSIYNPETQRLVWACAGVEIGRGQPLGVGLSGHPFYNKLDDTESSHAATSNVSEDVRDNVSVDYKQTQLCILGCAPAIGEHWAKGTACKSRPLSQGDCPPLELKNTVLEDGDMVDTGYGAMDFSTLQDTKCEVPLDICQSICKYPDYLQMSADPYGDSMFFCLRREQLFARHFWNRAGTMGDTVPQSLYIKGTGMRASPGSCVYSPSPSGSIVTSDSQLFNKPYWLHKAQGHNNGICWHNQLFVTVVDTTRSTNLTICASTQSPVPGQYDATKFKQYSRHVEEYDLQFIFQLCTITLTADVMSYIHSMNSSILEDWNFGVPPPPTTSLVDTYRFVQSVAITCQKDAAPAENKDPYDRLKFWNVDLKEKFSLDLDQYPLGRKFLVQAGLRRKPTIGPR

SEQ ID NO: 105 - DNA, 1605 bp, Artificial Sequence
  HPV18 L1
cattaccatctactacctctgtatggcccattgtatcacccacagcccctgcctctacacagtatattggtatacatggtacacattattatttgtggccattatattattttattcctaaaaagcgtaaacgtgttccctatttttttgcagatggctttgtggcggcctagtgacaataccgtataccttccacctccttctgtggcaagagttgtaaatactgatgattatgtgactcgcacaagcatattttatcatgctggcagctctagattattaactgttggtaatccatattttagggttcctgcaagtggtggcaataagcaggatattcctaaggtttctgcataccaatatagagtatttcgggtgcagttacctgacccaaataaatttggtttacctgataatagtatttataatcctgaaacacaacgtttagtgtgggcctgtgctggagtggaaattggccgtggtcagcctttaggtgttggccttagtgggcatccattttataataaattagatgacactgaaagttcccatgccgctacgtctaatgtttctgaggacgttagggacaatgtgtctgtagattataagcagacacagttatgtattttgggctgtgcccctgctattggggaacactgggctaaaggcactgcttgtaaatcgcgtcctttatcacagggcgattgcccccctttagaacttaaaaacacagttttggaagatggtgatatggtagatactggatatggtgccatggactttagtacattgcaagatactaaatgtgaggtaccattggatatttgtcagtctatttgtaaatatcctgattatttacaaatgtctgcagatccttatggggattccatgtttttttgcttacggcgtgagcagctttttgctaggcatttttggaatagggcaggtactatgggtgacactgtgcctcaatccttatatattaaaggcacaggtatgcgtgcttcacctggcagctgtgtgtattctccctctccaagtggctctattgttacctctgactcccagttgtttaataaaccatattggttacataaggcacagggtcataacaatggtatctgctggcataatcaattatttgttactgtggtagataccactcgtagtaccaatttaacaatatgtgcttctacacagtctcctgtacctgggcaatatgatgctaccaaatttaagcagtatagcagacatgttgaagaatatgatttgcagtttatttttcagttatgtactattactttaactgcagatgttatgtcctatattcatagtatgaatagcagtattttagaggattggaactttggtgttccccccccgccaactactagtttggtggatacatatcgttttgtacaatctgttgctattacctgtcaaaaggatgctgcaccagctgaaaataaggatccctatgataggttaaagttttggaatgtggatttaaaggaaaagttttctttggacttagatcaatatccccttggacgtaaatttttggtccaggctggattgcgtcgcaagcccaccataggccctcgt

SEQ ID NO: 106 - protein, 104 aa, Artificial Sequence
  E7
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKPHHHHHH

SEQ ID NO: 107 - protein, 98 aa, Artificial Sequence; identical to SEQ ID NO: 66
  E7

SEQ ID NO: 108 - protein, 164 aa, Artificial Sequence
  E6
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQLHHHHHH

SEQ ID NO: 109 - protein, 158 aa, Artificial Sequence; identical to SEQ ID NO: 51
  E6

SEQ ID NO: 110 - protein, 261 aa, Artificial Sequence
  E6E7
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQLHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKPHHHHHH

SEQ ID NO: 111 - protein, 255 aa, Artificial Sequence
  E6E7
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQLHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 112 - protein, 479 aa, Artificial Sequence
  L2
MRHKRSAKRTKRASATQLYKTCKQAGTCPPDIIPKVEGKTIADQILQYGSMGVFFGGLGIGTGSGTGGRTGYIPLGTRPPTATDTLAPVRPPLTVDPVGPSDPSIVSLVEETSFIDAGAPTSVPSIPPDVSGFSITTSTDTTPAILDINNTVTTVTTHNNPTFTDPSVLQPPTPAETGGHFTLSSSTISTHNYEEIPMDTFIVSTNPNTVTSSTPIPGSRPVARLGLYSRTTQQVKVVDPAFVTTPTKLITYDNPAYEGIDVDNTLYFSSNDNSINIAPDPDFLDIVALHRPALTSRRTGIRYSRIGNKQTLRTRSGKSIGAKVHYYYDFSTIDPAEEIELQTITPSTYTTTSHAASPTSINNGLYDIYADDFITDTSTTPVPSVPSTSLSGYIPANTTIPFGGAYNIPLVSGPDIPINITDQAPSLIPIVPGSPQYTIIADAGDFYLHPSYYMLRKRRKRLPYFFSDVSLAAHHHHHH

SEQ ID NO: 113 - protein, 473 aa, Artificial Sequence; identical to SEQ ID NO: 80
  L2

SEQ ID NO: 114 - DNA, 480 bp, Artificial Sequence
  E6
atgcatcaaaaacgtactgctatgttccaagatccacaagagcgtccacgtaaactgccgcagctgtgcaccgaactgcagaccactatccacgatatcattctggaatgcgtgtattgcaaacaacagctgctgcgtcgtgaagtctacgattttgcctttcgcgacctgtgcatcgtttatcgcgacggtaacccgtatgctgtctgcgacaaatgcctgaaattttacagcaaaatctccgagtatcgtcattactgctattctctgtacggcacgactctggaacagcagtataacaaaccgctgtgcgacctgctgattcgttgcattaactgccagaagccgctgtgtccggaagaaaaacaacgtcacctggacaaaaagcagcgcttccacaacatccgtggtcgttggaccggccgttgcatgagctgctgccgctccagccgtacccgccgtgaaactcagctgtaatga

SEQ ID NO: 115 - DNA, 498 bp, Artificial Sequence
  E6
atgcatcaaaaacgtactgctatgttccaagatccacaagagcgtccacgtaaactgccgcagctgtgcaccgaactgcagaccactatccacgatatcattctggaatgcgtgtattgcaaacaacagctgctgcgtcgtgaagtctacgattttgcctttcgcgacctgtgcatcgtttatcgcgacggtaacccgtatgctgtctgcgacaaatgcctgaaattttacagcaaaatctccgagtatcgtcattactgctattctctgtacggcacgactctggaacagcagtataacaaaccgctgtgcgacctgctgattcgttgcattaactgccagaagccgctgtgtccggaagaaaaacaacgtcacctggacaaaaagcagcgcttccacaacatccgtggtcgttggaccggccgttgcatgagctgctgccgctccagccgtacccgccgtgaaactcagctgcatcaccatcaccatcactaatga

SEQ ID NO: 116 - DNA, 305 bp, Artificial Sequence
  E7
atgcatggcgacaccccaactctgcatgaatacatgctggacctgcagccggaaacgaccgatctgtattgttacgaacagctgaacgattcctccgaagaagaagacgagatcgacggtccggcaggtcaagcggaaccagatcgtgcgcactataatatcgtgactttctgttgtaaatgtgactccaccctgcgtctgtgtgtgcagtctacccacgttgatatccgcaccctggaagatctgctgatgggcaccctgggtatcgtgtgcccgatctgcagccagaaaccgtaataagctga

SEQ ID NO: 117 - DNA, 323 bp, Artificial Sequence
  E7
atgcatggcgacaccccaactctgcatgaatacatgctggacctgcagccggaaacgaccgatctgtattgttacgaacagctgaacgattcctccgaagaagaagacgagatcgacggtccggcaggtcaagcggaaccagatcgtgcgcactataatatcgtgactttctgttgtaaatgtgactccaccctgcgtctgtgtgtgcagtctacccacgttgatatccgcaccctggaagatctgctgatgggcaccctgggtatcgtgtgcccgatctgcagccagaaaccgcatcaccatcaccatcactaataagctga

SEQ ID NO: 118 - DNA, 778 bp, Artificial Sequence
  E6E7
atgcatcaaaaacgcactgcaatgttccaggatccgcaagaacgtccacgtaagctgccgcagctgtgcactgagctgcaaactactatccatgacatcatcctggagtgtgtgtattgcaaacaacagctgctgcgtcgtgaagtgtacgatttcgccttccgtgacctgtgcatcgtttatcgtgacggtaatccatacgccgtttgcgacaaatgcctgaaattttacagcaaaatctccgaataccgtcactattgctactctctgtacggcacgaccctggaacagcaatataacaaaccgctgtgcgacctgctgattcgttgtattaactgccagaagcctctgtgtccggaggaaaaacagcgtcacctggacaagaaacagcgctttcataacatccgcggtcgctggactggtcgttgtatgtcctgctgccgttcttcccgcactcgccgcgagactcagctgcatggtgatactcctactctgcatgagtacatgctggacctgcaaccggaaaccactgatctgtattgttacgaacagctgaacgatagctctgaagaagaggacgaaatcgacggtccagcaggtcaggctgaaccggaccgcgctcattataacatcgttacgttttgctgcaaatgcgacagcaccctgcgtctgtgtgttcagtctacccacgtagatattcgtactctggaggatctgctgatgggcactctgggcatcgtttgcccgatctgttcccagaaaccgtaataagctgagc

SEQ ID NO: 119 - DNA, 796 bp, Artificial Sequence
  E6E7
atgcatcaaaaacgcactgcaatgttccaggatccgcaagaacgtccacgtaagctgccgcagctgtgcactgagctgcaaactactatccatgacatcatcctggagtgtgtgtattgcaaacaacagctgctgcgtcgtgaagtgtacgatttcgccttccgtgacctgtgcatcgtttatcgtgacggtaatccatacgccgtttgcgacaaatgcctgaaattttacagcaaaatctccgaataccgtcactattgctactctctgtacggcacgaccctggaacagcaatataacaaaccgctgtgcgacctgctgattcgttgtattaactgccagaagcctctgtgtccggaggaaaaacagcgtcacctggacaagaaacagcgctttcataacatccgcggtcgctggactggtcgttgtatgtcctgctgccgttcttcccgcactcgccgcgagactcagctgcatggtgatactcctactctgcatgagtacatgctggacctgcaaccggaaaccactgatctgtattgttacgaacagctgaacgatagctctgaagaagaggacgaaatcgacggtccagcaggtcaggctgaaccggaccgcgctcattataacatcgttacgttttgctgcaaatgcgacagcaccctgcgtctgtgtgttcagtctacccacgtagatattcgtactctggaggatctgctgatgggcactctgggcatcgtttgcccgatctgttcccagaaaccgcatcaccatcaccatcactaataagctgagc

SEQ ID NO: 120 - DNA, 1432 bp, Artificial Sequence
  L2
atgcgtcataaacgttctgcaaagcgtactaagcgtgctagcgcaactcagctgtacaaaacgtgtaaacaggcgggtacgtgtccgcctgacatcatcccgaaagttgaaggcaaaactatcgcggaccagattctgcagtacggttctatgggtgttttttttggtggtctgggtatcggcaccggttctggcaccggtggccgcacgggttatattccgctgggtactcgtccgccgactgcgaccgataccctggcaccggtacgtccgccgctgaccgtcgacccggttggtccgtctgatccgtctattgtgtctctggtcgaagagactagcttcattgacgctggtgcgccgacttctgttccgagcatcccgcctgatgttagcggtttctccatcactacttccaccgacaccaccccagctattctggatatcaacaacaccgttaccaccgtgaccacccataacaacccgaccttcaccgacccgtctgtcctgcagccgcctaccccggctgaaaccggcggtcacttcactctgtcttcttccaccatctctacccacaactatgaagagatccctatggacacttttatcgtgtccaccaaccctaacaccgtcacctcttctaccccgattccgggctctcgtccagtggctcgcctgggtctgtactcccgcaccactcagcaggtgaaggttgtcgatccggcgtttgtgaccactccgactaaactgatcacttacgataatccggcttacgaaggtattgatgtagacaatactctgtacttctcttccaatgacaacagcattaacatcgcgccggacccggactttctggatatcgttgcactgcaccgcccagccctgacctcccgtcgtactggtatccgttacagccgtatcggcaacaagcagaccctgcgtacccgctctggtaaatccatcggcgccaaagtacactactattacgacttttccactatcgatccggcagaagagattgaactgcagaccatcactccgtccacttatactaccacctcccacgctgcatccccgactagcattaacaatggtctgtacgatatctatgccgatgatttcattaccgacacgtctaccaccccggttccgtctgtcccgtccacctctctgtccggctatatcccggcgaacactacgattccgttcggtggtgcatacaacattccgctggtgagcggcccggacattccgatcaacatcaccgatcaggctccatctctgatcccgatcgtaccgggttccccacagtacactattattgctgatgcgggtgatttctatctgcatccttcttactacatgctgcgtaaacgtcgtaaacgtctgccatacttcttctctgacgttagcctggctgcttaataagctgagc

SEQ ID NO: 121 - DNA, 1450 bp, Artificial Sequence
  L2
atgcgtcataaacgttctgcaaagcgtactaagcgtgctagcgcaactcagctgtacaaaacgtgtaaacaggcgggtacgtgtccgcctgacatcatcccgaaagttgaaggcaaaactatcgcggaccagattctgcagtacggttctatgggtgttttttttggtggtctgggtatcggcaccggttctggcaccggtggccgcacgggttatattccgctgggtactcgtccgccgactgcgaccgataccctggcaccggtacgtccgccgctgaccgtcgacccggttggtccgtctgatccgtctattgtgtctctggtcgaagagactagcttcattgacgctggtgcgccgacttctgttccgagcatcccgcctgatgttagcggtttctccatcactacttccaccgacaccaccccagctattctggatatcaacaacaccgttaccaccgtgaccacccataacaacccgaccttcaccgacccgtctgtcctgcagccgcctaccccggctgaaaccggcggtcacttcactctgtcttcttccaccatctctacccacaactatgaagagatccctatggacacttttatcgtgtccaccaaccctaacaccgtcacctcttctaccccgattccgggctctcgtccagtggctcgcctgggtctgtactcccgcaccactcagcaggtgaaggttgtcgatccggcgtttgtgaccactccgactaaactgatcacttacgataatccggcttacgaaggtattgatgtagacaatactctgtacttctcttccaatgacaacagcattaacatcgcgccggacccggactttctggatatcgttgcactgcaccgcccagccctgacctcccgtcgtactggtatccgttacagccgtatcggcaacaagcagaccctgcgtacccgctctggtaaatccatcggcgccaaagtacactactattacgacttttccactatcgatccggcagaagagattgaactgcagaccatcactccgtccacttatactaccacctcccacgctgcatccccgactagcattaacaatggtctgtacgatatctatgccgatgatttcattaccgacacgtctaccaccccggttccgtctgtcccgtccacctctctgtccggctatatcccggcgaacactacgattccgttcggtggtgcatacaacattccgctggtgagcggcccggacattccgatcaacatcaccgatcaggctccatctctgatcccgatcgtaccgggttccccacagtacactattattgctgatgcgggtgatttctatctgcatccttcttactacatgctgcgtaaacgtcgtaaacgtctgccatacttcttctctgacgttagcctggctgctcatcaccatcaccatcactaataagctgagc

SEQ ID NO: 122 - protein, 657 aa, Artificial Sequence
  HPV18 E1 ACCESSION NO: NP_040312
MADPEGTDGEGTGCNGWFYVQAIVDKKTGDVISDDEDENATDTGSDMVDFIDTQGTFCEQAELETAQALFHAQEVHNDAQVLHVLKRKFAGGSTENSPLGERLEVDTELSPRLQEISLNSGQKKAKRRLFTISDSGYGCSEVEATQIQVTTNGEHGGNVCSGGSTEAIDNGGTEGNNSSVDGTSDNSNIENVNPQCTIAQLKDLLKVNNKQGAMLAVFKDTYGLSFTDLVRNFKSDKTTCTDWVTAIFGVNPTIAEGFKTLIQPFILYAHIQCLDCKWGVLILALLRYKCGKSRLTVAKGLSTLLHVPETCMLIQPPKLRSSVAALYWYRTGISNISEVMGDTPEWIQRLTIIQHGIDDSNFDLSEMVQWAFDNELTDESDMAFEYALLADSNSNAAAFLKSNCQAKYLKDCATMCKHYRRAQKRQMNMSQWIRFRCSKIDEGGDWRPIVQFLRYQQIEFITFLGALKSFLKGTPKKNCLVFCGPANTGKSYFGMSFIHFIQGAVISFVNSTSHFWLEPLTDTKVAMLDDATTTCWTYFDTYMRNALDGNPISIDRKHKPLIQLKCPPILLTTNIHPAKDNRWPYLESRITVFEFPNAFPFDKNGNPVYEINDKNWKCFFERTWSRLDLHEEEEDADTEGNPFGTFKLRAGQNHRPL

SEQ ID NO: 123 - protein, 649 aa, Artificial Sequence
  HPV16 E1 ACCESSION NO: AAO85410
MADPAGTNGEEGTGCNGWFYVEAVVEKKTGDAISDDENENDSDTGEDLVDFIVNDNDYLTQAETETAHALFTAQEAKEHRDAVQVLKRKYLGSPLSDISECVDNNISPRLKAICIEKQSRAAKRRLFESEDSGYGNTEVETQQMLQVEGRHETETPCSQYSGGSGGGSSQYSSGSGGEGVSERHTICETPLTNILNVLKTSNAKAAMLAKFKELYGVSFTELVRPFKSNKSTCCDWCIAAFGLTPSIADSIKTLLQQYCLYLHIQSLACSWGMVVLLLVRYKCGKNRETIEKLMSKLLCVSPMCMMIEPPKLRSTAAALYWYKTGMSNISAVYGDTPEWIQRQTVLQHSFNDCTFELSQMVQWAYDNDIVDDSEIAYKYAQLADTNSNASAFLKGNSQAKIVKDCATMCRHYKRAEKKQMSMSQWIKYRCDRVDDGGDWKQIVMFLRYQGVDFMSFLSALKKFLQGIPKKNCILLYGAANTGKSLFGMSLMKFLQGSVICFVNSKSHFWLQPLADAKIGMLDDATVPCWNYIDDNLRNALDGNLVSMDVKHRPLVQLKCPPLLITSNINAGTDSRWPYLHNRLVVFTFPNEFPFDKNGNPVYELNDKNWKSFFSRTWSRLSLHEDEDKENDGDSLPTFKCVSGQNTNTL

SEQ ID NO: 124 - protein, 649 aa, Artificial Sequence
  HPV6 E1 ACCESSION NO:  AAF00059
MADDSGTENEGSGCTGWFMVEAIVQHPTGTQISDDEDEEVEDSGYDMVDFIDDSNITHNSLEAQALFNRQEADTHYATVQDLKRKYLGSPYVSPINTIAEAVESEISPRLDAIKLTRQPKKVKRRLFQTRELTDSGYGYSEVEAGTGTQVEKHGVPENGGDGQEKDTGRDIEGEEHTEAEAPTNSVREHAGTAGILELLKCKDLRAALLGKFKECFGLSFIDLIRPFKSDKTTCADWVVAGFGIHHSISEAFQKLIEPLSLYAHIQWLTNAWGMVLLVLLRFKVNKSRSTVARTLATLLNIPENQMLIEPPKIQSGVAALYWFRTGISNASTVIGEAPEWITRQTVIEHGLADSQFKLTEMVQWAYDNDICEESEIAFEYAQRGDFDSNARAFLNSNMQAKYVKDCATMCRHYKHAEMRKMSIKQWIKHRGSKIEGTGNWKPIVQFLRHQNIEFIPFLSKFKLWLHGTPKKNCIAIVGPPDTGKSYFCMSLISFLGGTVISHVNSSSHFWLQPLVDAKVALLDDATQPCWIYMDTYMRNLLDGNPMSIDRKHKALTLIKCPPLLVTSNIDITKEEKYKYLHTRVTTFTFPNPFPFDRNGNAVYELSNANWKCFFERLSSSLDIQDSEDEEDGSNSQAFRCVPGTVVRTL

SEQ ID NO: 125 - protein, 649 aa, Artificial Sequence
  HPV11 E1 ACCESSION NO:  ACL12344
MADDSGTENEGSGCTGWFMVEAIVEHTTGTQISEDEEEEVEDSGYDMVDFIDDRHITQNSVEAQALFNRQEADAHYATVQDLKRKYLGSPYVSPISNVANAVESEISPRLDAIKLTTQPKKVKRRLFETRELTDSGYGYSEVEAATQVEKHGDPENGGDGQERDTGRDIEGEGVEHREAEAVDDSTREHADTSGILELLKCKDIRSTLHGKFKDCFGLSFVDLIRPFKSDRTTCADWVVAGFGIHHSIADAFQKLIEPLSLYAHIQWLTNAWGMVLLVLIRFKVNKSRCTVARTLGTLLNIPENHMLIEPPKIQSGVAALYWFRTGISNASTVIGEAPEWITRQTVIEHSLADSQFKLTEMVQWAYDNDICEESEIAFEYAQRGDFDSNARAFLNSNMQAKYVKDCAIMCRHYKHAEMKKMSIKQWIKYRGTKVDSVGNWKPIVQFLRHQNIEFIPFLSKLKLWLHGTPKKNCIAIVGPPDTGKSCFCMSLIKFLGGTVISYVNSCSHFWLQPLTDAKVALLDDATQPCWTYMDTYMRNLLDGNPMSIDRKHRALTLIKCPPLLVTSNIDISKEEKYKYLHSRVTTFTFPNPFPFDRNGNAVYELSDANWKCFFERLSSSLDIEDSEDEEDGSNSQAFRCVPGSVVRTL

SEQ ID NO: 126 - protein, 368 aa, Artificial Sequence
  HPV6 E2 ACCESSION NO:  AAF00060
MEAIAKRLDACQEQLLELYEENSTDLNKHVLHWKCIRHESVLLYKAKQMGLSHIGMQVVPPLKVSEAKGHNAIEMQMHLESLLKTEYSMEPWTLQETSYEMWQTPPKRCFKKRGKTVEVKFDGCANNTMDYVVWTDVYVQDTDSWVKVHSMVDAKGIYYTCGQFKTYYVNFVKEAEKYGSTKQWEVCYGSTVICSPASVSSTTQEVSIPESTTYTPAQTSTPVSSSTQEDAVQTPPRKRARGVQQSPCNALCVAHIGPVDSGNHNVITNNHDQHQRRNNSNSSATPIVQFQGESNCLKCFRYRLNDKHRHLFDLISSTWHWASSKAPHKHAIVTVTYHSEEQRQQFLNVVKIPPTIRHKLGFMSMHLL

SEQ ID NO: 127 - protein, 365 aa, Artificial Sequence
  HPV16 E2 ACCESSION NO:  AAD41260
METLCQRLNVCQDKILTHYENDSTDLRDHIDYWKQMRLECAIYYKAREMGFKHINHQVVPTLAVSKNKALQAIELQLTLETIYNSQYSNEKWTLQDVSLEVYLTAPTGCIKKHGYTVEVQFDGDICNTMHYTNWKYIYICEETSVTVVEGQVDYYGIYYVHEGIQTYFVQFKDDAEKYSKNKVWEVHAGGQVILCPTSVFSSDEVSSAEIIRQHLANHSATTHTKAVALGTKETQTTIQRPRSEPDTGNPCHTNKLLHRDSVDSAPILTAVNSSHKGRINCNSNTTPIVHLKGDANTLKCLRYRFKKHCKLYTAVSSTWHWTGHNVKHKSAIVTLTYDSECQREQFLSQVKIPKTITVSTGFMSI

SEQ ID NO: 128 - protein, 367 aa, Artificial Sequence
  HPV11 E2 ACCESSION NO:  ACL12345
MEAIAKRLDACQDQLLELYEENSIDIHKHIMHWKCIRLESVLLHKAKQMGLSHIGLQVVPPLTVSETKGHNAIEMQMHLESLAKTQYGVEPWTLQDTSYEMWLTPPKRCFKKQGNTVEVKFDGCEDNVMEYVVWTHIYLQDNDSWVKVTSSVDAKGIYYTCGQFKTYYVNFNKEAQKYGSTNHWEVCYGSTVICSPASVSSTVREVSIAEPTTYTPAQTTAPTVSACTTEDGVSAPPRKRARGPSTNNTLCVANIRSVDSTINNIVTDNYNKHQRRNNCHSAATPIVQLQGDSNCLKCFRYRLNDKYKHLFELASSTWHWASPEAPHKNAIVTLTYSSEEQRQQFLNSVKIPPTIRHKVGFMSLHLL

SEQ ID NO: 129 - protein, 363 aa, Artificial Sequence
  HPV18 E2 ACCESSION NO:  ABP99803
MQTPKETLSERLSALQDKIIDHYENDSKDIDSQIQYWQLIRWENAIFFAAREHGIQTLNHQVVPAYNISKSKAHKAIELQMALQGLAQSAYKTEDWTLQDTCEELWNTEPTHCFKKGGQTVQVYFDGNKDNSMNYVAWDSVYYMTDAGTWDKTATCVSHRGLYYVKEGYNTFYIEFKSECEKYGNTGTWEVHFGNNVIDCNDSMCSTSDDTVSATQLVKQLQHTPSPYSSTVSVGTAKTHGQTSAATRPEHCGLAETQQCGPVNPLLGAATGNNKRRKLCSGNTTPIIHLKGDRNSLKCLRYRLRKHSEHYKNISSTWHWTGACNEKTGILTVTYNSETQRTKFLNTVAIPDSVQILVGYMTM

SEQ ID NO: 130 - protein, 109 aa, Artificial Sequence
  HPV6 E4 ACCESSION NO:  AAF00061
MGAPNNGKYVMAAQLYVLLHLYLALHKKYPFLNLLHTPPHRPPPLCPQAPRKTQCKRRLENEHEESNSHLATPCVWPTLDPWTVETTTSSLTITTSTKEGTTVTVQLRL

SEQ ID NO: 131 - protein, 95 aa, Artificial Sequence
  HPV16 E4 ACCESSION NO:  ACL12314
YYVLHLCLAATKYPLLKLLGSTWPTTPPRPIPKPSPWAPKKHRRLSSDQDQSQTPETPATPLSCCTETQWTVLQSSLHLTAHTKDGLTVIVTLHP

SEQ ID NO: 132 - protein, 108 aa, Artificial Sequence
  HPV11 E4 ACCESSION NO:  ACL12346
MVVPIIGKYVMAAQLYVLLHLYLALYEKYPLLNLLHTPPHRPPPLQCPPAPRKTACRRRLGSEHVDRPLTTPCVWPTSDPWTVQSTTSSLTITTSTKEGTTVTVQLRL

SEQ ID NO: 133 - protein, 86 aa, Artificial Sequence
  HPV18 E4 ACCESSION NO:  ABP99804
MTLCAVPVTTRYPLLSLLNSYSTPPHRIPAPCPWAPQRPTARRRLLQDLNTVDLRRRSSVDLSTHFSVQLQATTKDGNSVVVTLRL

SEQ ID NO: 134 - protein, 150 aa, Artificial Sequence; identical to SEQ ID NO: 62
  HPV11 E6 ACCESSION NO: ACL12342

SEQ ID NO: 135 - protein, 158 aa, Artificial Sequence; identical to SEQ ID NO: 51
  HPV16 E6 ACCESSION NO: K02718

SEQ ID NO: 136 - protein, 158 aa, Artificial Sequence
  HPV18 E6 ACCESSION NO: ABP99800
MARFEDPTRRPYKLPDLCTELNTSLQDIEITCVYCKTVLELTEVFEFAFKDLFVVYRDSIPHAACHKCIDFYSRIRELRYYSDSVYGDTLEKLTNTGLYNLLIRCLRCQKPLNPAEKLRHLNEKRRFHKIAGHYRGQCHSCCNRARQERLQRRRETQV

SEQ ID NO: 137 - protein, 149 aa, Artificial Sequence
  HPV31 E6 ACCESSION NO: P17386
MFKNPAERPRKLHELSSALEIPYDELRLNCVYCKGQLTETEVLDFAFTDLTIVYRDDTPHGVCTKCLRFYSKVSEFRWYRYSVYGTTLEKLTNKGICDLLIRCITCQRPLCPEEKQRHLDKKKRFHNIGGRWTGRCIACWRRPRTETQV

SEQ ID NO: 138 - protein, 158 aa, Artificial Sequence
  HPV45 E6 ACCESSION NO: P21735
MARFDDPKQRPYKLPDLCTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCCDQARQERLRRRRETQV

SEQ ID NO: 139 - protein, 150 aa, Artificial Sequence
  HPV6 E6
MESANASTSATTIDQLSKTFNLSMHTLQINCVFCKNALTTAEIYSYAYKQLKVLFRGGYPYAACACCLEFHGKINQYRHFDYAGYATTVEEETKQDILDVLIRCYLCHKPLSEVEKVKHILTKARFIKLNCTWKGRCLHCWTTCMEDMLP

SEQ ID NO: 140 - protein, 150 aa, Artificial Sequence
  HPV11 E6
MESKDASTSATSIDQLSKTFNLSLHTLQIQCVFCRNALTTAEIYAYAYKNLKVVWRDNFPFAACACCLELQGKINQYRHFNYAAYAPTVEEETNEDILKVLIRCYLCHKPLSEIEKLKHILGKARFIKLNNQWKGRCLHCWTTCMEDLLP

SEQ ID NO: 141 - protein, 158 aa, Artificial Sequence
  HPV16 E6
MHQKRTAMFQDPQERPRKLPQLSTELQTTIHDIILECVYCKQQLLRREVYDFAFRDLSIVYRDGNPYAVCDKCLKFYSKISEYRHYSYSLYGTTLEQQYNKPLSDLLIRCINCQKPLSPEEKQRHLDKKQRFHNIRGRWTGRCMSCSRSSRTRRETQL

SEQ ID NO: 142 - protein, 158 aa, Artificial Sequence
  HPV18 E6
MARFEDPTRRPYKLPDLSTELNTSLQDIEITCVYCKTVLELTEVFEFAFKDLFVVYRDSIPHAACHKCIDFYSRIRELRYYSDSVYGDTLEKLTNTGLYNLLIRCLRCQKPLNPAEKLRHLNEKRRFHKIAGHYRGQCHSCSNRARQERLQRRRETQV

SEQ ID NO: 143 - protein, 149 aa, Artificial Sequence
  HPV31 E6
MFKNPAERPRKLHELSSALEIPYDELRLNCVYCKGQLTETEVLDFAFTDLTIVYRDDTPHGVCTKCLRFYSKVSEFRWYRYSVYGTTLEKLTNKGISDLLIRCITCQRPLSPEEKQRHLDKKKRFHNIGGRWTGRCIACWRRPRTETQV

SEQ ID NO: 144 - protein, 158 aa, Artificial Sequence
  HPV45 E6
MARFDDPKQRPYKLPDLSTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCSDQARQERLRRRRETQV

SEQ ID NO: 145 - protein, 592 aa, Artificial Sequence
  STF2.E6N (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAESANASTSATTIDQLSKTFNLSMHTLQINCVFCKNALTTAEIYSYAYKQLKVLFRGGYPYAACACCLEFHGKINQYRHFDYAGYAT

SEQ ID NO: 146 - protein, 592 aa, Artificial Sequence
  STF2.E6N (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAESKDASTSATSIDQLSKTFNLSLHTLQIQCVFCRNALTTAEIYAYAYKNLKVVWRDNFPFAACACCLELQGKINQYRHFNYAAYAP

SEQ ID NO: 147 - protein, 590 aa, Artificial Sequence
  STF2.E6N (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAQDPQERPRKLPQLSTELQTTIHDIILECVYCKQQLLRREVYDFAFRDLSIVYRDGNPYAVCDKCLKFYSKISEYRHYSYSLYGT

SEQ ID NO: 148 - protein, 590 aa, Artificial Sequence
  STF2.E6N (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAEDPTRRPYKLPDLSTELNTSLQDIEITCVYCKTVLELTEVFEFAFKDLFVVYRDSIPHAACHKCIDFYSRIRELRYYSDSVYGD

SEQ ID NO: 149 - protein, 589 aa, Artificial Sequence
  STF2.E6N (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLANPAERPRKLHELSSALEIPYDELRLNCVYCKGQLTETEVLDFAFTDLTIVYRDDTPHGVCTKCLRFYSKVSEFRWYRYSVYGT

SEQ ID NO: 150 - protein, 590 aa, Artificial Sequence
  STF2.E6N (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLADDPKQRPYKLPDLSTELNTSLQDVSIACVYCKATLERTEVYQFAFKDLCIVYRDCIAYAACHKCIDFYSRIRELRYYSNSVYGE

SEQ ID NO: 151 - protein, 576 aa, Artificial Sequence
  STF2.E6C (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLADYAGYATTVEEETKQDILDVLIRCYLCHKPLSEVEKVKHILTKARFIKLNCTWKGRCLHCWTTCMEDMLP

SEQ ID NO: 152 - protein, 576 aa, Artificial Sequence
  STF2.E6C (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLANYAAYAPTVEEETNEDILKVLIRCYLCHKPLSEIEKLKHILGKARFIKLNNQWKGRCLHCWTTCMEDLLP

SEQ ID NO: 153 - protein, 578 aa, Artificial Sequence
  STF2.E6C (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASYSVYGTTLEQQYNKPLSDLLIRCINCQKPLSPEEKQRHLDKKQRFHNIRGRWTGRCMSCSRSSRTRRETQL

SEQ ID NO: 154 - protein, 583 aa, Artificial Sequence
  STF2.E6C (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASDSVYGDTLEKLTNTGLYNLLIRCLRCQKPLNPAEKLRHLNEKRRFHKIAGHYRGQCHSCSNRARQERLQRRRETQV

SEQ ID NO: 155 - protein, 576 aa, Artificial Sequence
  STF2.E6C (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLARYSVYGTTLEKLTNKGISDLLIRCITCQRPLSPEEKQRHLDKKKRFHNIGGRWTGRCIACWRRPRTETQV

SEQ ID NO: 156 - protein, 583 aa, Artificial Sequence
  STF2.E6C (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASNSVYGETLEKITNTELYNLLIRCLRCQKPLNPAEKRRHLKDKRRFHSIAGQYRGQCNTCSDQARQERLRRRRETQV

SEQ ID NO: 157 - protein, 490 aa, Artificial Sequence
  STF2R3.E6N (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAESANASTSATTIDQLSKTFNLSMHTLQINCVFCKNALTTAEIYSYAYKQLKVLFRGGYPYAACACCLEFHGKINQYRHFDYAGYATVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 158 - protein, 490 aa, Artificial Sequence
  STF2R3.E6N (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAESKDASTSATSIDQLSKTFNLSLHTLQIQCVFCRNALTTAEIYAYAYKNLKVVWRDNFPFAACACCLELQGKINQYRHFNYAAYAPVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 159 - protein, 488 aa, Artificial Sequence
  STF2R3.E6N (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAQDPQERPRKLPQLSTELQTTIHDIILECVYCKQQLLRREVYDFAFRDLSIVYRDGNPYAVCDKCLKFYSKISEYRHYSYSLYGTVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 160 - protein, 488 aa, Artificial Sequence
  STF2R3.E6N (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAEDPTRRPYKLPDLSTELNTSLQDIEITCVYCKTVLELTEVFEFAFKDLFVVYRDSIPHAACHKCIDFYSRIRELRYYSDSVYGDVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 161 - protein, 487 aa, Artificial Sequence
  STF2R3.E6N (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKANPAERPRKLHELSSALEIPYDELRLNCVYCKGQLTETEVLDFAFTDLTIVYRDDTPHGVCTKCLRFYSKVSEFRWYRYSVYGTVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 162 - protein, 488 aa, Artificial Sequence
  STF2R3.E6N (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKADDPKQRPYKLPDLSTELNTSLQDVSIACVYCKATLERTEVYQFAFKDLCIVYRDCIAYAACHKCIDFYSRIRELRYYSNSVYGEVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 163 - protein, 474 aa, Artificial Sequence
  STF2R3.E6C (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKADYAGYATTVEEETKQDILDVLIRCYLCHKPLSEVEKVKHILTKARFIKLNCTWKGRCLHCWTTCMEDMLPVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 164 - protein, 474 aa, Artificial Sequence
  STF2R3.E6C (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKANYAAYAPTVEEETNEDILKVLIRCYLCHKPLSEIEKLKHILGKARFIKLNNQWKGRCLHCWTTCMEDLLPVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 165 - protein, 476 aa, Artificial Sequence
  STF2R3.E6C (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASYSVYGTTLEQQYNKPLSDLLIRCINCQKPLSPEEKQRHLDKKQRFHNIRGRWTGRCMSCSRSSRTRRETQLVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 166 - protein, 481 aa, Artificial Sequence
  STF2R3.E6C (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASDSVYGDTLEKLTNTGLYNLLIRCLRCQKPLNPAEKLRHLNEKRRFHKIAGHYRGQCHSCSNRARQERLQRRRETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 167 - protein, 474 aa, Artificial Sequence
  STF2R3.E6C (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKARYSVYGTTLEKLTNKGISDLLIRCITCQRPLSPEEKQRHLDKKKRFHNIGGRWTGRCIACWRRPRTETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 168 - protein, 481 aa, Artificial Sequence
  STF2R3.E6C (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASNSVYGETLEKITNTELYNLLIRCLRCQKPLNPAEKRRHLKDKRRFHSIAGQYRGQCNTCSDQARQERLRRRRETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 169 - protein, 560 aa, Artificial Sequence
  STF2R3E6N.E6C (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAESANASTSATTIDQLSKTFNLSMHTLQINCVFCKNALTTAEIYSYAYKQLKVLFRGGYPYAACACCLEFHGKINQYRHFDYAGYATVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLADYAGYATTVEEETKQDILDVLIRCYLCHKPLSEVEKVKHILTKARFIKLNCTWKGRCLHCWTTCMEDMLP

SEQ ID NO: 170 - protein, 560 aa, Artificial Sequence
  STF2R3E6N.E6C (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAESKDASTSATSIDQLSKTFNLSLHTLQIQCVFCRNALTTAEIYAYAYKNLKVVWRDNFPFAACACCLELQGKINQYRHFNYAAYAPVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLANYAAYAPTVEEETNEDILKVLIRCYLCHKPLSEIEKLKHILGKARFIKLNNQWKGRCLHCWTTCMEDLLP

SEQ ID NO: 171 - protein, 560 aa, Artificial Sequence
  STF2R3E6N.E6C (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAQDPQERPRKLPQLSTELQTTIHDIILECVYCKQQLLRREVYDFAFRDLSIVYRDGNPYAVCDKCLKFYSKISEYRHYSYSLYGTVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASYSVYGTTLEQQYNKPLSDLLIRCINCQKPLSPEEKQRHLDKKQRFHNIRGRWTGRCMSCSRSSRTRRETQL

SEQ ID NO: 172 - protein, 565 aa, Artificial Sequence
  STF2R3E6N.E6C (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAEDPTRRPYKLPDLSTELNTSLQDIEITCVYCKTVLELTEVFEFAFKDLFVVYRDSIPHAACHKCIDFYSRIRELRYYSDSVYGDVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASDSVYGDTLEKLTNTGLYNLLIRCLRCQKPLNPAEKLRHLNEKRRFHKIAGHYRGQCHSCSNRARQERLQRRRETQV

SEQ ID NO: 173 - protein, 557 aa, Artificial Sequence
  STF2R3E6N.E6C (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKANPAERPRKLHELSSALEIPYDELRLNCVYCKGQLTETEVLDFAFTDLTIVYRDDTPHGVCTKCLRFYSKVSEFRWYRYSVYGTVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLARYSVYGTTLEKLTNKGISDLLIRCITCQRPLSPEEKQRHLDKKKRFHNIGGRWTGRCIACWRRPRTETQV

SEQ ID NO: 174 - protein, 565 aa, Artificial Sequence
  STF2R3E6N.E6C (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKADDPKQRPYKLPDLSTELNTSLQDVSIACVYCKATLERTEVYQFAFKDLCIVYRDCIAYAACHKCIDFYSRIRELRYYSNSVYGEVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASNSVYGETLEKITNTELYNLLIRCLRCQKPLNPAEKRRHLKDKRRFHSIAGQYRGQCNTCSDQARQERLRRRRETQV

SEQ ID NO: 175 - protein, 560 aa, Artificial Sequence
  STF2R3E6C.E6N (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKADYAGYATTVEEETKQDILDVLIRCYLCHKPLSEVEKVKHILTKARFIKLNCTWKGRCLHCWTTCMEDMLPVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAESANASTSATTIDQLSKTFNLSMHTLQINCVFCKNALTTAEIYSYAYKQLKVLFRGGYPYAACACCLEFHGKINQYRHFDYAGYAT

SEQ ID NO: 176 - protein, 560 aa, Artificial Sequence
  STF2R3E6C.E6N (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKANYAAYAPTVEEETNEDILKVLIRCYLCHKPLSEIEKLKHILGKARFIKLNNQWKGRCLHCWTTCMEDLLPVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAESKDASTSATSIDQLSKTFNLSLHTLQIQCVFCRNALTTAEIYAYAYKNLKVVWRDNFPFAACACCLELQGKINQYRHFNYAAYAP

SEQ ID NO: 177 - protein, 560 aa, Artificial Sequence
  STF2R3E6C.E6N (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASYSVYGTTLEQQYNKPLSDLLIRCINCQKPLSPEEKQRHLDKKQRFHNIRGRWTGRCMSCSRSSRTRRETQLVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAQDPQERPRKLPQLSTELQTTIHDIILECVYCKQQLLRREVYDFAFRDLSIVYRDGNPYAVCDKCLKFYSKISEYRHYSYSLYGT

SEQ ID NO: 178 - protein, 565 aa, Artificial Sequence
  STF2R3E6C.E6N (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASDSVYGDTLEKLTNTGLYNLLIRCLRCQKPLNPAEKLRHLNEKRRFHKIAGHYRGQCHSCSNRARQERLQRRRETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAEDPTRRPYKLPDLSTELNTSLQDIEITCVYCKTVLELTEVFEFAFKDLFVVYRDSIPHAACHKCIDFYSRIRELRYYSDSVYGD

SEQ ID NO: 179 - protein, 557 aa, Artificial Sequence
  STF2R3E6C.E6N (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKARYSVYGTTLEKLTNKGISDLLIRCITCQRPLSPEEKQRHLDKKKRFHNIGGRWTGRCIACWRRPRTETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLANPAERPRKLHELSSALEIPYDELRLNCVYCKGQLTETEVLDFAFTDLTIVYRDDTPHGVCTKCLRFYSKVSEFRWYRYSVYGT

SEQ ID NO: 180 - protein, 565 aa, Artificial Sequence
  STF2R3E6C.E6N (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASNSVYGETLEKITNTELYNLLIRCLRCQKPLNPAEKRRHLKDKRRFHSIAGQYRGQCNTCSDQARQERLRRRRETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLADDPKQRPYKLPDLSTELNTSLQDVSIACVYCKATLERTEVYQFAFKDLCIVYRDCIAYAACHKCIDFYSRIRELRYYSNSVYGE

SEQ ID NO: 181 - protein, 655 aa, Artificial Sequence
  STF2.E6 (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAESANASTSATTIDQLSKTFNLSMHTLQINCVFCKNALTTAEIYSYAYKQLKVLFRGGYPYAACACCLEFHGKINQYRHFDYAGYATTVEEETKQDILDVLIRCYLCHKPLSEVEKVKHILTKARFIKLNCTWKGRCLHCWTTCMEDMLP

SEQ ID NO: 182 - protein, 655 aa, Artificial Sequence
  STF2.E6 (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAESKDASTSATSIDQLSKTFNLSLHTLQIQCVFCRNALTTAEIYAYAYKNLKVVWRDNFPFAACACCLELQGKINQYRHFNYAAYAPTVEEETNEDILKVLIRCYLCHKPLSEIEKLKHILGKARFIKLNNQWKGRCLHCWTTCMEDLLP

SEQ ID NO: 183 - protein, 655 aa, Artificial Sequence
  STF2.E6 (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAQDPQERPRKLPQLSTELQTTIHDIILECVYCKQQLLRREVYDFAFRDLSIVYRDGNPYAVCDKCLKFYSKISEYRHYSYSLYGTTLEQQYNKPLSDLLIRCINCQKPLSPEEKQRHLDKKQRFHNIRGRWTGRCMSCSRSSRTRRETQL

SEQ ID NO: 184 - protein, 660 aa, Artificial Sequence
  STF2.E6 (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAEDPTRRPYKLPDLSTELNTSLQDIEITCVYCKTVLELTEVFEFAFKDLFVVYRDSIPHAACHKCIDFYSRIRELRYYSDSVYGDTLEKLTNTGLYNLLIRCLRCQKPLNPAEKLRHLNEKRRFHKIAGHYRGQCHSCSNRARQERLQRRRETQV

SEQ ID NO: 185 - protein, 653 aa, Artificial Sequence
  STF2.E6 (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKNPAERPRKLHELSSALEIPYDELRLNCVYCKGQLTETEVLDFAFTDLTIVYRDDTPHGVCTKCLRFYSKVSEFRWYRYSVYGTTLEKLTNKGISDLLIRCITCQRPLSPEEKQRHLDKKKRFHNIGGRWTGRCIACWRRPRTETQV

SEQ ID NO: 186 - protein, 660 aa, Artificial Sequence
  STF2.E6 (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLADDPKQRPYKLPDLSTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCSDQARQERLRRRRETQV

SEQ ID NO: 187 - protein, 553 aa, Artificial Sequence
  STF2R3.E6 (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAESANASTSATTIDQLSKTFNLSMHTLQINCVFCKNALTTAEIYSYAYKQLKVLFRGGYPYAACACCLEFHGKINQYRHFDYAGYATTVEEETKQDILDVLIRCYLCHKPLSEVEKVKHILTKARFIKLNCTWKGRCLHCWTTCMEDMLPVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 188 - protein, 553 aa, Artificial Sequence
  STF2R3.E6 (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAESKDASTSATSIDQLSKTFNLSLHTLQIQCVFCRNALTTAEIYAYAYKNLKVVWRDNFPFAACACCLELQGKINQYRHFNYAAYAPTVEEETNEDILKVLIRCYLCHKPLSEIEKLKHILGKARFIKLNNQWKGRCLHCWTTCMEDLLPVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 189 - protein, 553 aa, Artificial Sequence
  STF2R3.E6 (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAQDPQERPRKLPQLSTELQTTIHDIILECVYCKQQLLRREVYDFAFRDLSIVYRDGNPYAVCDKCLKFYSKISEYRHYSYSLYGTTLEQQYNKPLSDLLIRCINCQKPLSPEEKQRHLDKKQRFHNIRGRWTGRCMSCSRSSRTRRETQLVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 190 - protein, 558 aa, Artificial Sequence
  STF2R3.E6 (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAEDPTRRPYKLPDLSTELNTSLQDIEITCVYCKTVLELTEVFEFAFKDLFVVYRDSIPHAACHKCIDFYSRIRELRYYSDSVYGDTLEKLTNTGLYNLLIRCLRCQKPLNPAEKLRHLNEKRRFHKIAGHYRGQCHSCSNRARQERLQRRRETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 191 - protein, 551 aa, Artificial Sequence
  STF2R3.E6 (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKNPAERPRKLHELSSALEIPYDELRLNCVYCKGQLTETEVLDFAFTDLTIVYRDDTPHGVCTKCLRFYSKVSEFRWYRYSVYGTTLEKLTNKGISDLLIRCITCQRPLSPEEKQRHLDKKKRFHNIGGRWTGRCIACWRRPRTETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 192 - protein, 558 aa, Artificial Sequence
  STF2R3.E6 (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKADDPKQRPYKLPDLSTELNTSLQDVSIACVYCKATLERTEVYQFAFKDLCIVYRDCIAYAACHKCIDFYSRIRELRYYSNSVYGETLEKITNTELYNLLIRCLRCQKPLNPAEKRRHLKDKRRFHSIAGQYRGQCNTCSDQARQERLRRRRETQVVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 193 - protein, 98 aa, Artificial Sequence; identical to SEQ ID NO: 76
  HPV11 E7 ACCESSION NO: ACL12343

SEQ ID NO: 194 - protein, 98 aa, Artificial Sequence; identical to SEQ ID NO: 66
  HPV16 E7 ACCESSION NO: AAD33253

SEQ ID NO: 195 - protein, 105 aa, Artificial Sequence
  HPV18 E7 ACCESSION NO;  AAP20595
MHGPKATLQDIVLHLEPQNEIPVDLLCHEQLSDSEEENDEIDGVNHQHLPARRAEPQRHTMLCMCCKCEARIELVVESSADDLRAFQQLFLNTLSFVCPWCASQQ

SEQ ID NO: 196 - protein, 98 aa, Artificial Sequence
  HPV31 E7 ACCESSION NO: P17387
MRGETPTLQDYVLDLQPEATDLHCYEQLPDSSDEEDVIDSPAGQAEPDTSNYNIVTFCCQCKSTLRLCVQSTQVDIRILQELLMGSFGIVCPNCSTRL

SEQ ID NO: 197 - protein, 106 aa, Artificial Sequence
  HPV45 E7 ACCESSION NO: P21736
MHGPRETLQEIVLHLEPQNELDPVDLLCYEQLSESEEENDEADGVSHAQLPARRAEPQRHKILCVCCKCDGRIELTVESSAEDLRTLQQLFLSTLSFVCPWCATNQ

SEQ ID NO: 198 - protein, 603 aa, Artificial Sequence
  STF2.E7 (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGRHVTLKDIVLDLQPPDPVGLHCYEQLVDSSEDEVDEVDGQDSQPLKQHYQIVTCCCGCDSNVRLVVQCTETDIREVQQLLLGTLNIVCPICAPKT

SEQ ID NO: 199 - protein, 603 aa, Artificial Sequence
  STF2.E7 (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGRLVTLKDIVLDLQPPDPVGLHCYEQLEDSSEDEVDKVDKQDAQPLTQHYQILTCCCGCDSNVRLVVECTDGDIRQLQDLLLGTLNIVCPICAPKP

SEQ ID NO: 200 - protein, 603 aa, Artificial Sequence
  STF2.E7 (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 201 - protein, 610 aa, Artificial Sequence
  STF2.E7 (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGPKATLQDIVLHLEPQNEIPVDLLCHEQLSDSEEENDEIDGVNHQHLPARRAEPQRHTMLCMCCKCEARIELVVESSADDLRAFQQLFLNTLSFVCPWCASQQ

SEQ ID NO: 202 - protein, 603 aa, Artificial Sequence
  STF2.E7 (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLARGETPTLQDYVLDLQPEATDLHCYEQLPDSSDEEDVIDSPAGQAEPDTSNYNIVTFCCQCKSTLRLCVQSTQVDIRILQELLMGSFGIVCPNCSTRL

SEQ ID NO: 203 - protein, 611 aa, Artificial Sequence
  STF2.E7 (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGPRETLQEIVLHLEPQNELDPVDLLCYEQLSESEEENDEADGVSHAQLPARRAEPQRHKILCVCCKCDGRIELTVESSAEDLRTLQQLFLSTLSFVCPWCATNQ

SEQ ID NO: 204 - protein, 509 aa, Artificial Sequence
  STF2R3.E7 (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGRHVTLKDIVLDLQPPDPVGLHCYEQLVDSSEDEVDEVDGQDSQPLKQHYQIVTCCCGCDSNVRLVVQCTETDIREVQQLLLGTLNIVCPICAPKTGSGSGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 205 - protein, 509 aa, Artificial Sequence
  STF2R3.E7 (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGRLVTLKDIVLDLQPPDPVGLHCYEQLEDSSEDEVDKVDKQDAQPLTQHYQILTCCCGCDSNVRLVVECTDGDIRQLQDLLLGTLNIVCPICAPKPGSGSGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 206 - protein, 509 aa, Artificial Sequence
  STF2R3.E7 (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKPGSGSGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 207 - protein, 516 aa, Artificial Sequence
  STF2R3.E7 (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGPKATLQDIVLHLEPQNEIPVDLLCHEQLSDSEEENDEIDGVNHQHLPARRAEPQRHTMLCMCCKCEARIELVVESSADDLRAFQQLFLNTLSFVCPWCASQQGSGSGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 208 - protein, 509 aa, Artificial Sequence
  STF2R3.E7 (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKARGETPTLQDYVLDLQPEATDLHCYEQLPDSSDEEDVIDSPAGQAEPDTSNYNIVTFCCQCKSTLRLCVQSTQVDIRILQELLMGSFGIVCPNCSTRLGSGSGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 209 - protein, 517 aa, Artificial Sequence
  STF2R3.E7 (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGPRETLQEIVLHLEPQNELDPVDLLCYEQLSESEEENDEADGVSHAQLPARRAEPQRHKILCVCCKCDGRIELTVESSAEDLRTLQQLFLSTLSFVCPWCATNQGSGSGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 210 - protein, 660 aa, Artificial Sequence
  STF2.E7.E7C (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGRHVTLKDIVLDLQPPDPVGLHCYEQLVDSSEDEVDEVDGQDSQPLKQHYQIVTCCCGCDSNVRLVVQCTETDIREVQQLLLGTLNIVCPICAPKTGQDSQPLKQHYQIVTCCCGCDSNVRLVVQCTETDIREVQQLLLGTLNIVCPICAPKT

SEQ ID NO: 211 - protein, 659 aa, Artificial Sequence
  STF2.E7.E7C (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGRLVTLKDIVLDLQPPDPVGLHCYEQLEDSSEDEVDKVDKQDAQPLTQHYQILTCCCGCDSNVRLVVECTDGDIRQLQDLLLGTLNIVCPICAPKPQDAQPLTQHYQILTCCCGCDSNVRLVVECTDGDIRQLQDLLLGTLNIVCPICAPKP

SEQ ID NO: 212 - protein, 659 aa, Artificial Sequence
  STF2.E7.E7C (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKPGQAEPDRAHYNIVTFCCKCDSTLRLCVQSTHVDIRTLEDLLMGTLGIVCPICSQKP

SEQ ID NO: 213 - protein, 669 aa, Artificial Sequence
  STF2.E7.E7C (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGPKATLQDIVLHLEPQNEIPVDLLCHEQLSDSEEENDEIDGVNHQHLPARRAEPQRHTMLCMCCKCEARIELVVESSADDLRAFQQLFLNTLSFVCPWCASQQQHLPARRAEPQRHTMLCMCCKCEARIELVVESSADDLRAFQQLFLNTLSFVCPWCASQQ

SEQ ID NO: 214 - protein, 659 aa, Artificial Sequence
  STF2.E7.E7C (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLARGETPTLQDYVLDLQPEATDLHCYEQLPDSSDEEDVIDSPAGQAEPDTSNYNIVTFCCQCKSTLRLCVQSTQVDIRILQELLMGSFGIVCPNCSTRLGQAEPDTSNYNIVTFCCQCKSTLRLCVQSTQVDIRILQELLMGSFGIVCPNCSTRL

SEQ ID NO: 215 - protein, 671 aa, Artificial Sequence
  STF2.E7.E7C (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGPRETLQEIVLHLEPQNELDPVDLLCYEQLSESEEENDEADGVSHAQLPARRAEPQRHKILCVCCKCDGRIELTVESSAEDLRTLQQLFLSTLSFVCPWCATNQHAQLPARRAEPQRHKILCVCCKCDGRIELTVESSAEDLRTLQQLFLSTLSFVCPWCATNQ

SEQ ID NO: 216 - protein, 566 aa, Artificial Sequence
  STF2R3E7N.2XE7C (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGRHVTLKDIVLDLQPPDPVGLHCYEQLVDSSEDEVDEVDGQDSQPLKVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGQDSQPLKQHYQIVTCCCGCDSNVRLVVQCTETDIREVQQLLLGTLNIVCPICAPKTGQDSQPLKQHYQIVTCCCGCDSNVRLVVQCTETDIREVQQLLLGTLNIVCPICAPKT

SEQ ID NO: 217 - protein, 564 aa, Artificial Sequence
  STF2R3E7N.2XE7C (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGRLVTLKDIVLDLQPPDPVGLHCYEQLEDSSEDEVDKVDKQDAQPLTVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAQDAQPLTQHYQILTCCCGCDSNVRLVVECTDGDIRQLQDLLLGTLNIVCPICAPKPQDAQPLTQHYQILTCCCGCDSNVRLVVECTDGDIRQLQDLLLGTLNIVCPICAPKP

SEQ ID NO: 218 - protein, 563 aa, Artificial Sequence
  STF2R3E7N.2XE7C (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGDTPTLHEYMLDLQPETTDLYCYEQLNDSSEEEDEIDGPAGQAEPDVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGQAEPDRAHYNIVTFCCKCDSTLRLCVQSTHVDIRTLEDLLMGTLGIVCPICSQKPGQAEPDRAHYNIVTFCCKCDSTLRLCVQSTHVDIRTLEDLLMGTLGIVCPICSQKP

SEQ ID NO: 219 - protein, 578 aa, Artificial Sequence
  STF2R3E7N.2XE7C (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGPKATLQDIVLHLEPQNEIPVDLLCHEQLSDSEEENDEIDGVNHQHLPARRAEVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLANHQHLPARRAEPQRHTMLCMCCKCEARIELVVESSADDLRAFQQLFLNTLSFVCPWCASQQQHLPARRAEPQRHTMLCMCCKCEARIELVVESSADDLRAFQQLFLNTLSFVCPWCASQQ

SEQ ID NO: 220 - protein, 564 aa, Artificial Sequence
  STF2R3E7N.2XE7C (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKARGETPTLQDYVLDLQPEATDLHCYEQLPDSSDEEDVIDSPAGQAEPDTVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGQAEPDTSNYNIVTFCCQCKSTLRLCVQSTQVDIRILQELLMGSFGIVCPNCSTRLGQAEPDTSNYNIVTFCCQCKSTLRLCVQSTQVDIRILQELLMGSFGIVCPNCSTRL

SEQ ID NO: 221 - protein, 581 aa, Artificial Sequence
  STF2R3ETN.2XE7C (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAHGPRETLQEIVLHLEPQNELDPVDLLCYEQLSESEEENDEADGVSHAQLPARRAEVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASHAQLPARRAEPQRHKILCVCCKCDGRIELTVESSAEDLRTLQQLFLSTLSFVCPWCATNQSHAQLPARRAEPQRHKILCVCCKCDGRIELTVESSAEDLRTLQQLFLSTLSFVCPWCATNQ

SEQ ID NO: 222 - protein, 570 aa, Artificial Sequence
  STF2R32XE7C.E7N (HPV6)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGQDSQPLKQHYQIVTCCCGCDSNVRLVVQCTETDIREVQQLLLGTLNIVCPICAPKTGQDSQPLKQHYQIVTCCCGCDSNVRLVVQCTETDIREVQQLLLGTLNIVCPICAPKTGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGRHVTLKDIVLDLQPPDPVGLHCYEQLVDSSEDEVDEVDGQDSQPLK

SEQ ID NO: 223 - protein, 568 aa, Artificial Sequence
  STF2R32XE7C.E7N (HPV11)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAQDAQPLTQHYQILTCCCGCDSNVRLVVECTDGDIRQLQDLLLGTLNIVCPICAPKPQDAQPLTQHYQILTCCCGCDSNVRLVVECTDGDIRQLQDLLLGTLNIVCPICAPKPGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGRLVTLKDIVLDLQPPDPVGLHCYEQLEDSSEDEVDKVDKQDAQPLT

SEQ ID NO: 224 - protein, 567 aa, Artificial Sequence
  STF2R32XE7C.E7N (HPV16)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGQAEPDRAHYNIVTFCCKCDSTLRLCVQSTHVDIRTLEDLLMGTLGIVCPICSQKPGQAEPDRAHYNIVTFCCKCDSTLRLCVQSTHVDIRTLEDLLMGTLGIVCPICSQKPGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGDTPTLHEYMLDLQPETTDLYCYEQLNDSSEEEDEIDGPAGQAEPD

SEQ ID NO: 225 - protein, 582 aa, Artificial Sequence
  STF2R32XE7C.E7N (HPV18)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKANHQHLPARRAEPQRHTMLCMCCKCEARIELVVESSADDLRAFQQLFLNTLSFVCPWCASQQQHLPARRAEPQRHTMLCMCCKCEARIELVVESSADDLRAFQQLFLNTLSFVCPWCASQQGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGPKATLQDIVLHLEPQNEIPVDLLCHEQLSDSEEENDEIDGVNHQHLPARRAE

SEQ ID NO: 226 - protein, 568 aa, Artificial Sequence
  STF2R32XE7C.E7N (HPV31)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGQAEPDTSNYNIVTFCCQCKSTLRLCVQSTQVDIRILQELLMGSFGIVCPNCSTRLGQAEPDTSNYNIVTFCCQCKSTLRLCVQSTQVDIRILQELLMGSFGIVCPNCSTRLGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLARGETPTLQDYVLDLQPEATDLHCYEQLPDSSDEEDVIDSPAGQAEPDT

SEQ ID NO: 227 - protein, 585 aa, Artificial Sequence
  STF2R32XE7C.E7N (HPV45)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASHAQLPARRAEPQRHKILCVCCKCDGRIELTVESSAEDLRTLQQLFLSTLSFVCPWCATNQSHAQLPARRAEPQRHKILCVCCKCDGRIELTVESSAEDLRTLQQLFLSTLSFVCPWCATNQGSGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHGPRETLQEIVLHLEPQNELDPVDLLCYEQLSESEEENDEADGVSHAQLPARRAE

SEQ ID NO: 228 - protein, 565 aa, Influenza A/Puerto Rico/8/34 HA
MKANLLVLLSALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 229 - protein, 564 aa, Influenza A/Vietnam/1203/2004 HA
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTDYPQYSEEARLKREEISGVKLESIGIYQILSIYSTVASSLALAIMVAGLSLWMCSNGSLQCR

SEQ ID NO: 230 - protein, 568 aa, Influenza A/Indonesia/5/2005 HA
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 231 - protein, 565 aa, Influenza A/New Caledonia/20/1999
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 232 - protein, 566 aa, Influenza A/South Carolina/1/18 HA
MEARLLVLLCAFAATNADTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVKLESMGVYQILAIYSTVASSLVLLVSLGAISFWMCSNGSLQCRICI

SEQ ID NO: 233 - protein, 329 aa, Influenza A/Wisconsin/67/2005 HA
QKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTR

SEQ ID NO: 234 - protein, 328 aa, Influenza A/X31 subtype H3N2 HA
QDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVIQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQT

SEQ ID NO: 235 - protein, 272 aa, Artificial Sequence
  PR/8 HA1-1
SHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVR

SEQ ID NO: 236 - protein, 274 aa, Artificial Sequence
  VN HA1-1
EKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVK

SEQ ID NO: 237 - protein, 274 aa, Artificial Sequence
  IND HA1-1
EKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVK

SEQ ID NO: 238 - protein, 272 aa, Artificial Sequence
  NC HA1-1
SHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVR

SEQ ID NO: 239 - protein, 267 aa, Artificial Sequence
  WIS HA1-1
QSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVK

SEQ ID NO: 240 - protein, 293 aa, Artificial Sequence
  B/Lee/40 HA1-1
TTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVK

SEQ ID NO: 241 - protein, 267 aa, Artificial Sequence
  A/Aichi/2/68 HA1-1
QSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVK

SEQ ID NO: 242 - protein, 294 aa, Artificial Sequence
  B/Malaysia/2506/2004 HA1-1
TTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 243 - protein, 294 aa, Artificial Sequence
  B/Ohio/1/2005 HA1-1
TTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 244 - protein, 293 aa, Artificial Sequence
  B/Shanghai/361/2002 HA1-1
TTTPIKSHFANLKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGHCPIWVK

SEQ ID NO: 245 - protein, 299 aa, Artificial Sequence
  HA1-1his (PR8)
MKFLVNVALVFMVVYISYIYASHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRHHHHHH

SEQ ID NO: 246 - protein, 301 aa, Artificial Sequence
  HA1-1his (VN)
MKFLVNVALVFMVVYISYIYAEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKHHHHHH

SEQ ID NO: 247 - protein, 301 aa, Artificial Sequence
  HA1-1his (IND)
MKFLVNVALVFMVVYISYIYAEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKHHHHHH

SEQ ID NO: 248 - protein, 299 aa, Artificial Sequence
  HA1-1his (NC)
MKFLVNVALVFMVVYISYIYASHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRHHHHHH

SEQ ID NO: 249 - protein, 223 aa, Artificial Sequence
  PR/8 HA1-2
KGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 250 - protein, 223 aa, Artificial Sequence
  VN HA1-2
GVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 251 - protein, 223 aa, Artificial Sequence
  IND HA1-2
GVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSE

SEQ ID NO: 252 - protein, 223 aa, Artificial Sequence
  NC HA1-2
KGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITS

SEQ ID NO: 253 - protein, 218 aa, Artificial Sequence
  WIS HA1-2
SPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSD

SEQ ID NO: 254 - protein, 223 aa, Artificial Sequence
  PR/8 HA1-2mut
KGAAPLQLGKCNIAGWLLGNPECDPLLPVRSWSDIAETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 255 - protein, 223 aa, Artificial Sequence
  VN HA1-2mut
GAKPLSLRDCSVAGWLLGNPMCDEFINVPEWSDIAEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 256 - protein, 223 aa, Artificial Sequence
  IND HA1-2mut
GAKPLSLRDCSVAGWLLGNPMCDEFINVPEWSDIAEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSE

SEQ ID NO: 257 - protein, 223 aa, Artificial Sequence
  NC HA1-2mut
KGAAPLQLGNCSVAGWILGNPECELLISKESWSDIAETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITS

SEQ ID NO: 258 - protein, 218 aa, Artificial Sequence
  WIS HA1-2mut
SPHQALDGENCTLIDALLGDPQCDGFQNKKWDDFAERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSD

SEQ ID NO: 259 - protein, 240 aa, Artificial Sequence
  B/Lee/40 HA1-2
KGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKG

SEQ ID NO: 260 - protein, 216 aa, Artificial Sequence
  A/Aichi/2/68 HA1-2
HRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSD

SEQ ID NO: 261 - protein, 241 aa, Artificial Sequence
  B/Malaysia/2506/2004 HA1-2
KGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 262 - protein, 241 aa, Artificial Sequence
  B/Ohio/1/2005 HA1-2
KGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 263 - protein, 240 aa, Artificial Sequence
  B/Shanghai/361/2002 HA1-L
KGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKG

SEQ ID NO: 264 - protein, 176 aa, Artificial Sequence
  PR/8 HA1-3
NSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRG

SEQ ID NO: 265 - protein, 174 aa, Artificial Sequence
  VN HA1-3
NDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKG

SEQ ID NO: 266 - protein, 174 aa, Artificial Sequence
  IND HA1-3
NDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKG

SEQ ID NO: 267 - protein, 176 aa, Artificial Sequence
  NC HA1-3
NPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRG

SEQ ID NO: 268 - protein, 169 aa, Artificial Sequence
  WIS HA1-3
SNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSG

SEQ ID NO: 269 - protein, 176 aa, Artificial Sequence
  PR/8 HA1-3mut
NSENEICYPGDFIDKEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAAALSRG

SEQ ID NO: 270 - protein, 174 aa, Artificial Sequence
  VN HA1-3mut
NDLCYPGDFNDKEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIAKKG

SEQ ID NO: 271 - protein, 174 aa, Artificial Sequence
  IND HA1-3mut
NDLCYPGSFNDKEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIAKKG

SEQ ID NO: 272 - protein, 176 aa, Artificial Sequence
  NC HA1-3mut
NPENETCYPGYFADKEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAAALSRG

SEQ ID NO: 273 - protein, 169 aa, Artificial Sequence
  WIS HA1-3mut
SNCYPKDSPDEASLRSLVASSGTDEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSG

SEQ ID NO: 274 - protein, 19 aa, Artificial Sequence
  HA
PAKLLKERGRRGAIAGFLE

SEQ ID NO: 275 - protein, 26 aa, Artificial Sequence
  HA FluB
SLWSEEPAKLLKERGFFGAIAGFLEE

SEQ ID NO: 276 - protein, 26 aa, Artificial Sequence
  HA FluA H1/H0
SLWSEENIPSIQSRGLFGAIAGFIEE

SEQ ID NO: 277 - protein, 26 aa, Artificial Sequence
  HA FluA H3/H0
SLWSEENVPEKQTRGIFGAIAGFIEE

SEQ ID NO: 278 - protein, 30 aa, Artificial Sequence
  HA FluA H5/H0
SLWSEEEWEERERRRKKRGLFGAIAGFIEE

SEQ ID NO: 279 - protein, 20 aa, Artificial Sequence
  HA
NIPSIQSRGLFGAIAGFIEE

SEQ ID NO: 280 - protein, 20 aa, Artificial Sequence
  HA
NVPEKQTRGIFGAIAGFIEE

SEQ ID NO: 281 - protein, 20 aa, Artificial Sequence
  HA
RERRRKKRGLFGAIAGFIEE

SEQ ID NO: 282 - DNA, 72 bp, Artificial Sequence
  M2
agcttgctgactgaggttgagaccccgattcgcaacgaatggggttcccgttccaacgattcttccgacccg

SEQ ID NO: 283 - protein, 19 aa, Artificial Sequence
  Maturational cleavage site
NVPEKQTRGIFGAIAGFIE

SEQ ID NO: 284 - protein, 19 aa, Artificial Sequence
  Maturational cleavage site
NIPSIQSRGLFGAIAGFIE

SEQ ID NO: 285 - protein, 19 aa, Artificial Sequence
  Maturational cleavage site
PAKLLKERGFFGAIAGFLE

SEQ ID NO: 286 - protein, 19 aa, Artificial Sequence
  Maturational cleavage site
RERRRKKRGLFGAIAGFIE

SEQ ID NO: 287 - protein, 12 aa, Artificial Sequence
  VARIANT 4: Xaa = Any Amino Acid
  Maturational cleavage site
RGLXGAIAGFIE

SEQ ID NO: 288 - protein, 12 aa, Artificial Sequence
  VARIANT 4: Xaa = Any Amino Acid
  Maturational cleavage site
RGLXGAIAGFIE

SEQ ID NO: 289 - protein, 12 aa, Artificial Sequence
  Maturational cleavage site
RGLFGAIAGFIE

SEQ ID NO: 290 - protein, 12 aa, Artificial Sequence
  Maturational cleavage site
RGFFGAIAGFLE

SEQ ID NO: 291 - protein, 19 aa, Artificial Sequence
  Maturational cleavage site
NVPEKQTRGIFGAIAGFIE

SEQ ID NO: 292 - protein, 19 aa, Artificial Sequence
  Maturational cleavage site
NVPQIESRGLFGAIAGFIE

SEQ ID NO: 293 - protein, 19 aa, Artificial Sequence
  Maturational cleavage site
NIPSIQSRGLFGAIAGFIE

SEQ ID NO: 294 - protein, 19 aa, Artificial Sequence
  Maturational cleavage site
RERRRKKRGLFGAIAGFIE

SEQ ID NO: 295 - protein, 19 aa, Artificial Sequence
  Maturational cleavage site
PAKLLKERGFFGAIAGFLE

SEQ ID NO: 296 - protein, 97 aa, Artificial Sequence
  M2 influenza A
MSLLTEVETPIRNEWGCRCNDSSDPLVVAASIIGILHLILWILDRLFFKCIYRLFKHGLKRGPSTEGVPESMREEYRKEQQNAVDADDSHFVSIELE

SEQ ID NO: 297 - DNA, 294 bp, Artificial Sequence
  M2 influenza A
atgagccttctaaccgaggtcgaaacacctatcagaaacgaatgggggtgcagatgcaacgattcaagtgacccgcttgttgttgccgcgagtatcattgggatcttgcacttgatattgtggattcttgatcgtctttttttcaaatgcatctatcgactcttcaaacacggccttaaaagagggccttctacggaaggagtacctgagtctatgagggaagaatatcgaaaggaacagcagaatgctgtggatgctgacgacagtcattttgtcagcatagagttggagtaa

SEQ ID NO: 298 - protein, 24 aa, Artificial Sequence
  M2
SLLTEVETPIRNEWGCRCNDSSDP

SEQ ID NO: 299 - DNA, 75 bp, Artificial Sequence
  M2
atgagcctgctgaccgaggtcgaaacaccgatccgcaacgaatgggggtgccgctgcaacgattcaagtgacccg

SEQ ID NO: 300 - protein, 24 aa, Artificial Sequence
  M2
SLLTEVETPIRNEWGSRSNDSSDP

SEQ ID NO: 301 - protein, 24 aa, Artificial Sequence
  M2
SLLTEVETPIRNEWGCRCNGSSDP

SEQ ID NO: 302 - protein, 24 aa, Artificial Sequence
  M2
SLLTEVETPIRNEWGCKCNDSSDP

SEQ ID NO: 303 - protein, 24 aa, Artificial Sequence
  M2
SLLTEVETPIRNEWGCRCNDSSDP

SEQ ID NO: 304 - protein, 24 aa, Artificial Sequence
  M2
SLLTEVETPIRNEWGCRCNDSSDP

SEQ ID NO: 305 - protein, 24 aa, Artificial Sequence
  M2
SLLTEVETPIRNEWECRCNGSSDP

SEQ ID NO: 306 - protein, 24 aa, Artificial Sequence
  M2
SLLTEVETPTRNEWECRCSDSSDP

SEQ ID NO: 307 - protein, 24 aa, Artificial Sequence
  M2
SLLTEVETPIRNEWGSRSNGSSDP

SEQ ID NO: 308 - protein, 24 aa, Artificial Sequence
  M2
SLLTEVETLTRNGWGCRCSDSSDP

SEQ ID NO: 309 - protein, 24 aa, Artificial Sequence
  M2
SLLTEVETPTRNEWECRCSDSSDP

SEQ ID NO: 310 - protein, 24 aa, Artificial Sequence
  M2
SLLTEVETPTRNGWECKCSDSSDP

SEQ ID NO: 311 - protein, 24 aa, Artificial Sequence
  M2
SLLTEVETPTRNGWGCRCSGSSDP

SEQ ID NO: 312 - protein, 24 aa, Artificial Sequence
  M2
SLLTEVETLTRNGWECKCRDSSDP

SEQ ID NO: 313 - protein, 24 aa, Artificial Sequence
  M2
SLLTEVETPIRNEWGSKSNDSSDP

SEQ ID NO: 314 - protein, 24 aa, Artificial Sequence
  M2
SLLTEVETPIRNEWGSRSNDSSDP

SEQ ID NO: 315 - protein, 24 aa, Artificial Sequence
  M2
SLLTEVETPIRNEWESRSNGSSDP

SEQ ID NO: 316 - protein, 24 aa, Artificial Sequence
  M2
SLLTEVETPTRNEWESRSSDSSDP

SEQ ID NO: 317 - protein, 24 aa, Artificial Sequence
  M2
SLLTEVETLTRNGWGSRSSDSSDP

SEQ ID NO: 318 - protein, 24 aa, Artificial Sequence
  M2
SLLTEVETPTRNEWESRSSDSSDP

SEQ ID NO: 319 - protein, 24 aa, Artificial Sequence
  M2
SLLTEVETPTRNGWESKSSDSSDP

SEQ ID NO: 320 - protein, 24 aa, Artificial Sequence
  M2
SLLTEVETPTRNGWGSRSSGSSDP

SEQ ID NO: 321 - protein, 24 aa, Artificial Sequence
  M2
SLLTEVETLTRNGWESKSRDSSDP

SEQ ID NO: 322 - DNA, 72 bp, Artificial Sequence; identical to SEQ ID NO: 282
  M2

SEQ ID NO: 323 - protein, 11 aa, Artificial Sequence
  M2
EVETPIRNEWG

SEQ ID NO: 324 - protein, 9 aa, Artificial Sequence
  M2
EVETPIRNE

SEQ ID NO: 325 - protein, 10 aa, Artificial Sequence
  M2
EVETPIRNEW

SEQ ID NO: 326 - protein, 24 aa, Artificial Sequence
  M2
SLLTEVETPTRNEWESRSSDSSDP

SEQ ID NO: 327 - protein, 24 aa, Artificial Sequence
  M2
SLLTEVETPTRNEWECRCSDSSDP

SEQ ID NO: 328 - protein, 24 aa, Artificial Sequence
  M2
SLLTEVETLTRNGWGSRSSDSSDP

SEQ ID NO: 329 - protein, 24 aa, Artificial Sequence
  M2
SLLTEVETLTRNGWGCRCSDSSDP

SEQ ID NO: 330 - protein, 24 aa, Artificial Sequence
  M2
SLLTEVETPTRNGWESKSSDSSDP

SEQ ID NO: 331 - protein, 24 aa, Artificial Sequence
  M2
SLLTEVETPTRNGWECKCSDSSDP

SEQ ID NO: 332 - protein, 24 aa, Artificial Sequence
  M2
SLLTEVETLTRNGWESKSRDSSDP

SEQ ID NO: 333 - protein, 24 aa, Artificial Sequence
  M2
SLLTEVETLTRNGWECKCRDSSDP

SEQ ID NO: 334 - protein, 24 aa, Artificial Sequence
  Maturational cleavage site
SLLTEVETPIRNEWGSRSNDSSDP

SEQ ID NO: 335 - protein, 29 aa, Artificial Sequence
  Maturational cleavage site
GSGAGSLLTEVETPTRNEWECRCSDSSDP

SEQ ID NO: 336 - protein, 29 aa, Artificial Sequence
  Maturational cleavage site
GSGAGSLLTEVETLTRNGWGCRCSDSSDP

SEQ ID NO: 337 - protein, 496 aa, Artificial Sequence
  Tick-borne encephalitis
SRCTHLENRDFVTGTQGTTRVTLVLELGGCVTITAEGKPSMDVWLDSIYQENPAKTREYCLHAKLSDTKVAARCPTMGPATLTEEHQSGTVCKRDQSDRGWGNHCGLFGKGSIVTCVKVACEAKKKAIGHVYDANKIVYTVKVEPHTGDYVAANETHSGRKTASFTVSSEKTILTMGDYGDVPLLCRVASGVDLAQTVILELDKTLEHLPTAWQVHRDWFNDLALPWKHEGAQQWNNAERLVEFGAPHAVKMDVYNLGDQTGVLLKSLAGVPVAHIDGTKYHLKSGHVTCEVGLEKLKMKGLTYTMCDKTKFAWKRTPTDSGHDTVVMEVTFSGTKPCRIPVRAVAHGSPDVNVAMLITPNPTIENNGGGFIEMQLPPGDNIIYVGELSHQWFQKGSSIGRVFQKTRKGIERLTVIGEHAWDFGSTGGFLTSVGKALHTVLGGAFNSIFGGVGFLPKLLLGVALAWLGLNMRNPTMSMSFLLAGGLVLAMTLGVGA

SEQ ID NO: 338 - DNA, 1488 bp, Artificial Sequence
  Tick-borne encephalitis
tcgcggtgcacacatttggagaacagggactttgtcactggtactcagggaaccacgagagtgactctggtgttggagctggggggatgtgtcacgatcactgctgaggggaagccctcaatggatgtgtggctcgattccatctatcaggagaaccctgccaagacacgcgagtactgtctgcatgccaagctgtcggacaccaaagttgcggccagatgcccaacaatggggcctgccactctgactgaggagcatcagagtggtacggtgtgcaagagagaccagagtgaccgaggctggggcaatcactgcggattgtttggaaagggcagtattgtgacctgtgtcaaggtggcttgtgaggcaaagaagaaggccattggacatgtgtatgatgccaacaagatcgtgtacaccgttaaggttgagccacacacgggggactatgttgccgccaatgaaacccacagtgggaggaagacggcatccttcacggtctcctcagaaaagaccatcttgactatgggggactatggagatgtgcccttgttgtgcagagtcgccagtggcgttgacttggctcagactgtcattcttgagcttgacaagactctggaacaccttccaacagcctggcaggtccatcgtgactggttcaatgatctggctctaccgtggaaacacgaaggagcgcaacaatggaacaatgctgagcgactggttgaatttggagctccgcatgccgttaaaatggacgtgtataaccttggagatcaaactggggtgttgttgaagtcacttgctggggttcctgtggcgcacattgatggaacaaagtaccacctaaaaagcggccatgtaacatgcgaggttggactagaaaagctcaaaatgaagggtctcacatacacaatgtgtgacaaaacgaagttcgcatggaagcggactccaacagacagcggacatgacacagtggtcatggaggtcacgttctctggaacaaaaccttgcaggatcccagtgcgggcagtggcacacggctctccagatgtaaatgtggccatgctgataacaccaaaccccaccattgagaacaatggaggtggcttcatagagatgcagctacccccaggggataacatcatctatgttggggaactaagccatcagtggttccagaaggggagcagcatcggaagggtgtttcaaaagaccaggaagggcatcgagagactgacagtgataggagaacacgcctgggacttcggttccactggaggtttcttgacttcggtaggcaaagcgctgcacacagtcctcggcggagccttcaacagcatctttgggggagtggggtttctgcccaagctcctgttgggtgtggccttagcctggttgggcctgaacatgaggaaccccaccatgtccatgagtttcctcttggctgggggactggtcctggctatgacacttggagtgggtgct

SEQ ID NO: 339 - protein, 495 aa, Artificial Sequence
  Dengue 1
MRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIAQYENLKYSVIVTVHTGDQHQVGNETTEHGTTATITPQAPTSEIQLTDYGTLTLDCSPRTGLDFNEMVLLTMKKKSWLVHKQWFLDLPLPWTSGALTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSVMCIAVGMVTLYLGVMVQA

SEQ ID NO: 340 - DNA, 1485 bp, Artificial Sequence
  Dengue 1
atgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagctcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaaaagaaatcatggcttgtccacaaacagtggtttctagacttaccactgccttggacctctggggctttaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcggtgatgtgcatcgcagttggcatggtcacactgtacctaggagtcatggttcaggca

SEQ ID NO: 341 - protein, 406 aa, Artificial Sequence
  West Nile virus envelope protein
FNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 342 - DNA, 1218 bp, Artificial Sequence
  West Nile virus envelope protein
ttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttgtccatggaccaactactgtggagtcgcacggaaactactccacacaggttggagccactcaggcagggagattcagcatcactcctgcagcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 343 - protein, 495 aa, Artificial Sequence
  Dengue 2
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSTTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 344 - DNA, 1485 bp, Artificial Sequence
  Dengue 2
atgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccaccacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggcc

SEQ ID NO: 345 - protein, 493 aa, Artificial Sequence
  Dengue 3
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQA

SEQ ID NO: 346 - DNA, 1479 bp, Artificial Sequence
  Dengue 3
atgagatgcgtgggagtaggaaacagagattttgtggaaggtctgtcgggagctacgtgggttgatgtggtgctcgagcacggagggtgtgtgaccaccatggctaagaacaagcctacgctggacatagagctccagaagaccgaggccacccaactggcgaccctaagaaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgttgaagctatcttgcctgaatatggaacccttgggctagaatgttcaccacggacaggtttggatttcaacgaaatgattttattgacaatgaagaacaaagcatggatggtacataggcaatggttctttgacctacccctaccatggacatcaggagctacaacagagacaccaacttggaacaggaaagagctccttgtgacattcaagaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctctgaaacgcagcatgggacaatactcatcaaggttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgattgggattggagacaaagccttgaaaattaactggtacaagaagggaagctcgattggaaagatgttcgaggctactgccagaggtgcaaggcgcatggccatcttgggagacacagcctgggattttggttcagtgggtggtgttctgaattcattagggaaaatggtacaccaaatattcggaagtgcttacacagccctgtttagtggagtctcatggataatgaaaattggaataggtgtcctcttaacctggatagggttgaattcaaaaaacacttccatgtcattttcatgcattgcgataggaattattacactctatctgggagccgtggtacaagct

SEQ ID NO: 347 - protein, 491 aa, Artificial Sequence
  Dengue 4
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVRIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCEVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGF

SEQ ID NO: 348 - DNA, 1473 bp, Artificial Sequence
  Dengue 4
atgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccgaattgagaaccttgaatacacagtggtggtaacagtccacaatggagacacccatgcagtaggaaatgacacatccaatcatggagttacagccatgataacccccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcgaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggattgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttc

SEQ ID NO: 349 - protein, 406 aa, Artificial Sequence
  Japanese encephalitis
FNCLGMGNRDFIEGASGAAWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEGAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKA

SEQ ID NO: 350 - DNA, 1217 bp, Artificial Sequence
  Japanese encephalitis
tttaattgtctgggaatgggcaatcgtgacttcatagaaggagccagtggagccgcttgggtgacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaggggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggcc

SEQ ID NO: 351 - protein, 27 aa, Artificial Sequence
  Dengue virus
EAEPPFGESYIVVGAGEKALKLSWFKK

SEQ ID NO: 352 - protein, 27 aa, Artificial Sequence
  Dengue virus
ETEPPFGESYIVVGAGEKALKLSWFKK

SEQ ID NO: 353 - protein, 27 aa, Artificial Sequence
  Dengue virus
EAEPPFGDSYIIIGVEPQQLKLNWFKK

SEQ ID NO: 354 - protein, 27 aa, Artificial Sequence
  Dengue virus
EAEPPFGESNIVIGIGDKALKINWYKK

SEQ ID NO: 355 - protein, 27 aa, Artificial Sequence
  Dengue virus
ELEPPFGESYIVIGVGNSALTLHWFRK

SEQ ID NO: 356 - protein, 115 aa, Artificial Sequence
  West Nile Domain III
MEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 357 - DNA, 345 bp, Artificial Sequence
  West Nile Domain III
atggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 358 - protein, 103 aa, Artificial Sequence
  West Nile Domain III
GTTYGVCSKAFKFARTPADTGHGTVVLELQYTGKDGPCKVPISSVASLNDLTPVGRLVTVNPFVSVATANSKVLIELEPPFGDSYIVVGRGEQQINHHWHKSG

SEQ ID NO: 359 - protein, 102 aa, Artificial Sequence
  West Nile Domain III
GTTYGVCSKAFKFLGTPADTGHGTVVLELQYTGTDGPCKVPISSVASLNDLTPVGRLVTVNPFVSVATANAKVLIELEPPFGDSYVVGRGEQQINHHWHKSG

SEQ ID NO: 360 - protein, 27 aa, Artificial Sequence
  West Nile Domain III
ELEPPFGDSYIVVGRGEQQINHHWHKS

SEQ ID NO: 361 - protein, 20 aa, Artificial Sequence
  West Nile Virus E peptide
LTSGHLKCRVKMEKLQLKGT

SEQ ID NO: 362 - protein, 96 aa, Artificial Sequence
  Langat virus
GLTYTVCDKTKFTWKRAPTDSGHDTVVMEVGFSGTRPCRIPVRAVAHGVPEVNVAMLITPNPTMENNGGGFIEMQLPPGDNIIYVGDLNHQWFQKG

SEQ ID NO: 363 - protein, 103 aa, Artificial Sequence
  Kunjin virus
GTTYGVCSKAFRFLGTPADTGHGTVVLELQYTGTDGPCKIPISSVASLNDLTPVGRLVTVNPFVSVSTANAKVLIELEPPFGDSYIVVGRGEQQINHHWHKSG

SEQ ID NO: 364 - protein, 103 aa, Artificial Sequence
  Murray Valley virus
GTTYGMCTEKFTFSKNPADTGHGTVVLELQYTGSDGPCKIPISSVASLNDMTPVGRMVTANPYVASSTANAKVLVEIEPPFGDSYIVVGRGDKQINHHWHKEG

SEQ ID NO: 365 - protein, 103 aa, Artificial Sequence
  Japanese encephalitis virus
GTTYGMCTEKFSFAKNPADTGHGTVVIELSYSGSDGPCKIPIVSVASLNDMTPVGRLVTVNPFVATSSANSKVLVEMEPPFGSDYIVVGMGDKQINHHWHKAG

SEQ ID NO: 366 - protein, 26 aa, Artificial Sequence
  Japanese encephalitis virus
EMEPPFGDSYIVVMGDKQINHHWHKA

SEQ ID NO: 367 - protein, 95 aa, Artificial Sequence
  Tick-borne encephalitis virus
GLTYTMCDKTKFTWKRAPTDSGHDTVVMEVTFSGTKPCRIPVRAVAHGSPDVNVAMLITPNPTIENNGGGFIEMQLPPGDNIIYVGELSHQWFQK

SEQ ID NO: 368 - protein, 94 aa, Artificial Sequence
  Yellow fever virus
GLTYTMCDKTFTWKRAPTDSGHDTVVMEVTFSGTKPCRIPVRAVAHGSPDVNVAMLITPNPTIENNGGGFIEMQLPPGDNIIYVGELSHQWFQK

SEQ ID NO: 369 - protein, 95 aa, Artificial Sequence
  Flavivirus envelope protein
GTTYGMCSKKFTFRPADTGHGTVVLELQYSGDGPCKIPISVASKNDLTPVGRLVTVNPFVSSTANAKVLIEMEPPFGDSYIVVGGEQINHHWHKG

SEQ ID NO: 370 - protein, 99 aa, Artificial Sequence
  Flavivirus
GMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKK

SEQ ID NO: 371 - protein, 27 aa, Artificial Sequence
  Dengue 2E peptide
EAEPPFGDSYIIIGVEPGQLKLNWFKK

SEQ ID NO: 372 - protein, 24 aa, Artificial Sequence
  BCRABL peptide
SLLTEVETPIRNEWGSRSNDSSDP

SEQ ID NO: 373 - protein, 192 aa, Artificial Sequence
  Hepatitis C E1
YQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDA

SEQ ID NO: 374 - DNA, 576 bp, Artificial Sequence
  Hepatitis C E1
taccaagtgcgcaactccacggggctctaccacgtcaccaatgattgccctaactcgagtattgtgtacgaggcggccgatgccatcctgcacactccggggtgcgtcccttgcgttcgcgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctgtgcgggtctgtctttcttgtcggccaactgtttaccttctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcg

SEQ ID NO: 375 - protein, 363 aa, Artificial Sequence
  Hepatitis C E2
ETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEA

SEQ ID NO: 376 - DNA, 1089 bp, Artificial Sequence
  Hepatitis C E2
gaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacactatatttaaaatcaggatgtacgtgggaggggtcgagcacaggctggaagctgcctgcaactggacgcggggcgaacgttgcgatctggaagatagggacaggtccgagctcagcccgttactgctgaccactacacagtggcaggtcctcccgtgttccttcacaaccctgccagccttgtccaccggcctcatccacctccaccagaacattgtggacgtgcagtacttgtacggggtggggtcaagcatcgcgtcctgggccattaagtgggagtacgtcgtcctcctgttccttctgcttgcagacgcgcgcgtctgctcctgcttgtggatgatgctactcatatcccaagcggaagcg

SEQ ID NO: 377 - protein, 116 aa, Artificial Sequence
  JEIII+
MDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKA

SEQ ID NO: 378 - DNA, 348 bp, Artificial Sequence
  JEIII+
atggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggcc

SEQ ID NO: 379 - protein, 27 aa, Artificial Sequence
  West Nile virus
LTSGHLKCRVKMEKLQLKGTTYGVCSK

SEQ ID NO: 380 - protein, 27 aa, Artificial Sequence
  Japanese encephalitis virus
LTSGHLKCRLKMDKLALKGTTYGMCTE

SEQ ID NO: 381 - protein, 27 aa, Artificial Sequence
  Dengue virus
IFAGHLKCRLKMDKLTLKGMSYVMCTG

SEQ ID NO: 382 - protein, 27 aa, Artificial Sequence
  Dengue virus
LFTGHLKCRLRMDKLQLKGMSYSMCTG

SEQ ID NO: 383 - protein, 27 aa, Artificial Sequence
  Dengue virus
IFAGHLKCRLKMDKLKLKGMSYAMCLN

SEQ ID NO: 384 - protein, 27 aa, Artificial Sequence
  Dengue virus
MFAGHLKCKVRMEKLRIKGMSYTMCSG

SEQ ID NO: 385 - protein, 27 aa, Artificial Sequence
  VARIANT 1, 2, 3, 10, 11, 13, 16, 20, 21, 23, 24, 26, 27: Xaa = Any Amino Acid
  Flavivirus envelope protein
XXXGHLKCRXXMXKLXLKGXXYXXCXX

SEQ ID NO: 386 - protein, 14 aa, Artificial Sequence
  Flavivirus envelope protein
GHLKCRMKLLKGYC

SEQ ID NO: 387 - protein, 100 aa, Artificial Sequence
  Dengue virus
KGMSYVMCTGSFKLEKEVAETQHGTVLVQVKYEGTDAPCKIPFSTQDEKGVTQNGRLITANPIVTDKEKPVNIEAEPPFGENYIVVGAGEKALKLSWFKK

SEQ ID NO: 388 - protein, 100 aa, Artificial Sequence
  Dengue virus
KGMSYSMCTGKFKVVKEIAETQHGTIVIRVQYEGDGSPCKTPFEIMDLEKRHVLGRLTTVNPIVTEKDSPVNIEAEPPFGDSYIIIGVEPGQLKLDWFKK

SEQ ID NO: 389 - protein, 100 aa, Artificial Sequence
  Dengue virus
KGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYRK

SEQ ID NO: 390 - protein, 99 aa, Artificial Sequence
  Dengue virus
KGMSYTMCSGKFSIDKEMAETQHGTTVVKVKYEGAGAPCKVPIEIRDVNKEKVVGRIISPTPFAENTNSVTNIELERPLDSYIVIGVGDSALTLHWFRK

SEQ ID NO: 391 - protein, 20 aa, Artificial Sequence
  Flavivirus envelope protein
CRVKMEKLQLKGTTYGVCSK

SEQ ID NO: 392 - protein, 20 aa, Artificial Sequence
  Flavivirus envelope protein
SRVKMEKLQLKGTTYGVCSK

SEQ ID NO: 393 - protein, 20 aa, Artificial Sequence
  Flavivirus envelope protein
CRVKMEKLQLKGTTYGVSSK

SEQ ID NO: 394 - protein, 20 aa, Artificial Sequence
  Flavivirus envelope protein
SRVKMEKLQLKGTTYGVSSK

SEQ ID NO: 395 - protein, 20 aa, Artificial Sequence
  Flavivirus envelope protein
CRVKMEKLQLKGTTYGVCSK

SEQ ID NO: 396 - protein, 20 aa, Artificial Sequence
  Flavivirus envelope protein
ARVKMEKLQLKGTTYGVCSK

SEQ ID NO: 397 - protein, 20 aa, Artificial Sequence
  Flavivirus envelope protein
CAVKMEKLQLKGTTYGVCSK

SEQ ID NO: 398 - protein, 20 aa, Artificial Sequence
  Flavivirus envelope protein
CRAKMEKLQLKGTTYGVCSK

SEQ ID NO: 399 - protein, 20 aa, Artificial Sequence
  Flavivirus envelope protein
CRVAMEKLQLKGTTYGVCSK

SEQ ID NO: 400 - protein, 20 aa, Artificial Sequence
  Flavivirus envelope protein
CRVKAEKLQLKGTTYGVCSK

SEQ ID NO: 401 - protein, 20 aa, Artificial Sequence
  Flavivirus envelope protein
CRVKMAKLQLKGTTYGVCSK

SEQ ID NO: 402 - protein, 20 aa, Artificial Sequence
  Flavivirus envelope protein
CRVKMEALQLKGTTYGVCSK

SEQ ID NO: 403 - protein, 20 aa, Artificial Sequence
  Flavivirus envelope protein
CRVKMEKAQLKGTTYGVCSK

SEQ ID NO: 404 - protein, 20 aa, Artificial Sequence
  Flavivirus envelope protein
CRVKMEKLALKGTTYGVCSK

SEQ ID NO: 405 - protein, 20 aa, Artificial Sequence
  Flavivirus envelope protein
CRVKMEKLQAKGTTYGVCSK

SEQ ID NO: 406 - protein, 20 aa, Artificial Sequence
  Flavivirus envelope protein
CRVKMEKLQLAGTTYGVCSK

SEQ ID NO: 407 - protein, 20 aa, Artificial Sequence
  Flavivirus envelope protein
CRVKMEKLQLKATTYGVCSK

SEQ ID NO: 408 - protein, 20 aa, Artificial Sequence
  Flavivirus envelope protein
CRVKMEKLQLKGATYGVCSK

SEQ ID NO: 409 - protein, 20 aa, Artificial Sequence
  Flavivirus envelope protein
CRVKMEKLQLKGTAYGVCSK

SEQ ID NO: 410 - protein, 20 aa, Artificial Sequence
  Flavivirus envelope protein
CRVKMEKLQLKGTTAGVCSK

SEQ ID NO: 411 - protein, 20 aa, Artificial Sequence
  Flavivirus envelope protein
CRVKMEKLQLKGTTYAVCSK

SEQ ID NO: 412 - protein, 20 aa, Artificial Sequence
  Flavivirus envelope protein
CRVKMEKLQLKGTTYGACSK

SEQ ID NO: 413 - protein, 20 aa, Artificial Sequence
  Flavivirus envelope protein
CRVKMEKLQLKGTTYGVASK

SEQ ID NO: 414 - protein, 20 aa, Artificial Sequence
  Flavivirus envelope protein
CRVKMEKLQLKGTTYGVCAK

SEQ ID NO: 415 - protein, 20 aa, Artificial Sequence
  Flavivirus envelope protein
CRVKMEKLQLKGTTYGVCSA

SEQ ID NO: 416 - protein, 20 aa, Artificial Sequence
  Flavivirus envelope protein
CRVKMEKLQLKGTTYGVCSK

SEQ ID NO: 417 - protein, 20 aa, Artificial Sequence
  Flavivirus envelope protein
SNTVKLTSGHLKCRVKMEKL

SEQ ID NO: 418 - protein, 20 aa, Artificial Sequence
  Flavivirus envelope protein
NTVKLTSGHLKCRVKMEKLQ

SEQ ID NO: 419 - protein, 20 aa, Artificial Sequence
  Flavivirus envelope protein
TVKLTSGHLKCRVKMEKLQL

SEQ ID NO: 420 - protein, 20 aa, Artificial Sequence
  Flavivirus envelope protein
VKLTSGHLKCRVKMEKLQLK

SEQ ID NO: 421 - protein, 20 aa, Artificial Sequence
  Flavivirus envelope protein
KLTSGHLKCRVKMEKLQLKG

SEQ ID NO: 422 - protein, 20 aa, Artificial Sequence
  Flavivirus envelope protein
LTSGHLKCRVKMEKLQLKGT

SEQ ID NO: 423 - protein, 20 aa, Artificial Sequence
  Flavivirus envelope protein
TSGHLKCRVKMEKLQLKGTT

SEQ ID NO: 424 - protein, 20 aa, Artificial Sequence
  Flavivirus envelope protein
SGHLKCRVKMEKLQLKGTTY

SEQ ID NO: 425 - protein, 20 aa, Artificial Sequence
  Flavivirus envelope protein
GHLKCRVKMEKLQLKGTTYG

SEQ ID NO: 426 - protein, 20 aa, Artificial Sequence
  Flavivirus envelope protein
HLKCRVKMEKLQLKGTTYGV

SEQ ID NO: 427 - protein, 20 aa, Artificial Sequence
  Flavivirus envelope protein
LKCRVKMEKLQLKGTTYGVC

SEQ ID NO: 428 - protein, 20 aa, Artificial Sequence
  Flavivirus envelope protein
KCRVKMEKLQLKGTTYGVCS

SEQ ID NO: 429 - protein, 20 aa, Artificial Sequence
  Flavivirus envelope protein
CRVKMEKLQLKGTTYGVCSK

SEQ ID NO: 430 - protein, 20 aa, Artificial Sequence
  Flavivirus envelope protein
RVKMEKLQLKGTTYGVCSKA

SEQ ID NO: 431 - protein, 20 aa, Artificial Sequence
  Flavivirus envelope protein
VKMEKLQLKGTTYGVCSKAF

SEQ ID NO: 432 - protein, 20 aa, Artificial Sequence
  Flavivirus envelope protein
KMEKLQLKGTTYGVCSKAFK

SEQ ID NO: 433 - protein, 20 aa, Artificial Sequence
  Flavivirus envelope protein
MEKLQLKGTTYGVCSKAFKF

SEQ ID NO: 434 - protein, 20 aa, Artificial Sequence
  Flavivirus envelope protein
EKLQLKGTTYGVCSKAFKFL

SEQ ID NO: 435 - protein, 20 aa, Artificial Sequence
  Flavivirus envelope protein
KLQLKGTTYGVCSKAFKFLG

SEQ ID NO: 436 - protein, 20 aa, Artificial Sequence
  Flavivirus envelope protein
LQLKGTTYGVCSKAFKFLGT

SEQ ID NO: 437 - protein, 20 aa, Artificial Sequence
  Flavivirus envelope protein
QLKGTTYGVCSKAFKFLGTP

SEQ ID NO: 438 - protein, 20 aa, Artificial Sequence
  Flavivirus envelope protein
LKGTTYGVCSKAFKFLGTPA

SEQ ID NO: 439 - protein, 20 aa, Artificial Sequence
  Flavivirus envelope protein
KGTTYGVCSKAFKFLGTPAD

SEQ ID NO: 440 - protein, 20 aa, Artificial Sequence
  Flavivirus envelope protein
GTTYGVCSKAFKFLGTPADT

SEQ ID NO: 441 - protein, 20 aa, Artificial Sequence
  Flavivirus envelope protein
TTYGVCSKAFKFLGTPADTG

SEQ ID NO: 442 - protein, 20 aa, Artificial Sequence
  Flavivirus envelope protein
TYGVCSKAFKFLGTPADTGH

SEQ ID NO: 443 - protein, 20 aa, Artificial Sequence
  West Nile virus
LTSGHLKCRVKMEKLQLKGT

SEQ ID NO: 444 - protein, 110 aa, Artificial Sequence
  Domain III of West Nile virus
LKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 445 - protein, 110 aa, Artificial Sequence
  Domain III of Japanese encephalitis
KGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKA

SEQ ID NO: 446 - DNA, 345 bp, Artificial Sequence; identical to SEQ ID NO: 357
  West Nile EIII+

SEQ ID NO: 447 - protein, 506 aa, Artificial Sequence
  STF2 (s. typhimurium fliB)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 448 - protein, 300 aa, Artificial Sequence
  STF2 (S. typhimurium fliC)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAG

SEQ ID NO: 449 - protein, 595 aa, Artificial Sequence
  STF2 (E. coli fliC)
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDLTAAKMDAATNTITTTNNALTASKALDQLKDGDTVTIKADAAQTATVYTYNASAGNFSFSNVSNNTSAKAGDVAASLLPPAGQTASGVYKAASGEVNFDVDANGKITIGGQEAYLTSDGNLTTNDAGGATAATLDGLFKKAGDGQSIGFNKTASVTMGGTTYNFKTGADAGAATANAGVSFTDTASKETVLNKVATAKQGTAVAANGDTSATITYKSGVQTYQAVFAAGDGTASAKYADNTDVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQVPQQVLSLLQG

SEQ ID NO: 450 - protein, 317 aa, Artificial Sequence
  STF2 (B. subtilis)
MRINHNIAALNTSRQLNAGSDSAAKNMEKLSSGLRINRAGDDAAGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGTTYTVSGDQNTLTATDGSTATWADADDATNKPAGYYDAGGKVIASEKLAADSKVTKGIDISSSAKAASSALTTIKTAIDTVSSERAKLGAVQNRLEHTINNLGTSSENLTSAESRIRDVDMASEMMEYTKNNILTQASQAMLAQANQ

SEQ ID NO: 451 - protein, 729 aa, Artificial Sequence
  STF2.HA1-2 (VN)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 452 - protein, 628 aa, Artificial Sequence
  STF2R3.HA1-2 (VN)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSESVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 453 - protein, 642 aa, Artificial Sequence
  STF2R0.HA1-2 (VN)
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 454 - protein, 527 aa, Artificial Sequence
  HA0 (VN)
VLSLLRQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYST

SEQ ID NO: 455 - protein, 851 aa, Artificial Sequence
  STF2R3.2x.HA1-2 (VN)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSESVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 456 - protein, 272 aa, Artificial Sequence
  HA1-1 (VN)
SHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVR

SEQ ID NO: 457 - protein, 611 aa, Artificial Sequence
  STF2.4xM2e
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRLSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 458 - DNA, 2214 bp, Artificial Sequence
  nucleic acid sequence for STF2.HA1-2 PR8
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgttctggttctggttctggttctaaaggtattgctccactgcaactgggtaaatgcaatattgcgggttggctgctgggcaacccggaatgcgatccgctgctgccggtccgttcctggagctatattgttgaaactccgaactctgagaacggcatctgctatccaggtgatttcattgactatgaggaactgcgtgaacaactgtcttccgtgtcttcctttgaacgtttcgagatttttcctaaagaatcttcttggccgaaccataacactaatggtgttaccgctgcgtgctctcatgaaggtaaatctagcttttaccgcaacctgctgtggctgaccgagaaagaaggttcttacccgaaactgaaaaacagctacgtaaacaaaaagggcaaggaagttctggtcctgtggggtatccaccatccgccgaacagcaaggaacagcagaatctgtatcagaacgaaaacgcatacgtatctgttgttacttctaactacaaccgccgtttcacccctgaaatcgcggaacgtccgaaagtgcgtgaccaggcaggccgcatgaactattactggaccctgctgaagccgggtgatactatcatcttcgaagcgaacggtaacctgatcgccccgatgtacgcgttcgctctgagccgtggcttcggctctggtatcattacgtcttaataa

SEQ ID NO: 459 - DNA, 669 bp, Artificial Sequence
  HA1-2 PR8
aaaggtattgctccactgcaactgggtaaatgcaatattgcgggttggctgctgggcaacccggaatgcgatccgctgctgccggtccgttcctggagctatattgttgaaactccgaactctgagaacggcatctgctatccaggtgatttcattgactatgaggaactgcgtgaacaactgtcttccgtgtcttcctttgaacgtttcgagatttttcctaaagaatcttcttggccgaaccataacactaatggtgttaccgctgcgtgctctcatgaaggtaaatctagcttttaccgcaacctgctgtggctgaccgagaaagaaggttcttacccgaaactgaaaaacagctacgtaaacaaaaagggcaaggaagttctggtcctgtggggtatccaccatccgccgaacagcaaggaacagcagaatctgtatcagaacgaaaacgcatacgtatctgttgttacttctaactacaaccgccgtttcacccctgaaatcgcggaacgtccgaaagtgcgtgaccaggcaggccgcatgaactattactggaccctgctgaagccgggtgatactatcatcttcgaagcgaacggtaacctgatcgccccgatgtacgcgttcgctctgagccgtggcttcggctctggtatcattacgtct

SEQ ID NO: 460 - protein, 736 aa, Artificial Sequence
  STF2.HA1-2 PR8
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRSGSGSGSKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 461 - DNA, 2193 bp, Artificial Sequence
  STF2.HA1-2 SI
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgaaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactcttaataa

SEQ ID NO: 462 - DNA, 669 bp, Artificial Sequence
  HA1-2 SI
aaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactct

SEQ ID NO: 463 - protein, 729 aa, Artificial Sequence
  STF2.HA1-2 SI
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 464 - protein, 628 aa, Artificial Sequence
  STF2R3.HA1-2 (PR8)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 465 - protein, 628 aa, Artificial Sequence
  STF2R3.HA1-2 (SI)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 466 - DNA, 1935 bp, Artificial Sequence
  STF2R3.HA1-2 B/Fla (codon optimized)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctagtactcgtacccgcggtaaactgtgcccagattgcctgaactgcaccgacctggacgtagcactgggccgtcctatgtgcgtgggtactacgccgtctgcaaaagctagcattctgcacgaggttaaaccagtgacctccggttgctttccgattatgcatgatcgcacgaaaatccgtcagctgccgaacctgctgcgtggctacgaaaacattcgtctgtccactcagaacgttatcgacgcagaaaaagcgccgggtggcccgtaccgtctgggtacctctggtagctgcccgaacgcaacgtccaaaagcggtttcttcgcaaccatggcatgggccgttccgaaggacaacaacaaaaacgctacgaatccactgactgttgaggtgccgtacatttgcaccgaaggcgaagaccaaatcaccgtatggggcttccactccgatgacaaaacccagatgaaaaacctgtacggtgactccaaccctcagaagttcacttcttctgcgaacggcgttacgacccactacgttagccaaattggttcctttccggaccagaccgaagacggcggtctgccgcagtctggtcgtatcgtggttgattatatgatgcagaaaccgggcaaaaccggcacgatcgtttatcagcgtggtgtgctgctgccgcagaaggtttggtgcgcgtctggtcgctccaaagtaatcaaaggttcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttacgttag

SEQ ID NO: 467 - DNA, 717 bp, Artificial Sequence
  nucleic acid sequence for HA1-2 B/Fla (codon optimized)
agtactcgtacccgcggtaaactgtgcccagattgcctgaactgcaccgacctggacgtagcactgggccgtcctatgtgcgtgggtactacgccgtctgcaaaagctagcattctgcacgaggttaaaccagtgacctccggttgctttccgattatgcatgatcgcacgaaaatccgtcagctgccgaacctgctgcgtggctacgaaaacattcgtctgtccactcagaacgttatcgacgcagaaaaagcgccgggtggcccgtaccgtctgggtacctctggtagctgcccgaacgcaacgtccaaaagcggtttcttcgcaaccatggcatgggccgttccgaaggacaacaacaaaaacgctacgaatccactgactgttgaggtgccgtacatttgcaccgaaggcgaagaccaaatcaccgtatggggcttccactccgatgacaaaacccagatgaaaaacctgtacggtgactccaaccctcagaagttcacttcttctgcgaacggcgttacgacccactacgttagccaaattggttcctttccggaccagaccgaagacggcggtctgccgcagtctggtcgtatcgtggttgattatatgatgcagaaaccgggcaaaaccggcacgatcgtttatcagcgtggtgtgctgctgccgcagaaggtttggtgcgcgtctggtcgctccaaagtaatcaaaggt

SEQ ID NO: 468 - protein, 745 aa, Artificial Sequence
  STF2.HA1-2 (B/Fla)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKG

SEQ ID NO: 469 - DNA, 2655 bp, Artificial Sequence
  nucleic acid sequence for STF2R3.2x.HA1-2 B/Fla(codon optimized)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctagtactcgtacccgcggtaaactgtgcccagattgcctgaactgcaccgacctggacgtagcactgggccgtcctatgtgcgtgggtactacgccgtctgcaaaagctagcattctgcacgaggttaaaccagtgacctccggttgctttccgattatgcatgatcgcacgaaaatccgtcagctgccgaacctgctgcgtggctacgaaaacattcgtctgtccactcagaacgttatcgacgcagaaaaagcgccgggtggcccgtaccgtctgggtacctctggtagctgcccgaacgcaacgtccaaaagcggtttcttcgcaaccatggcatgggccgttccgaaggacaacaacaaaaacgctacgaatccactgactgttgaggtgccgtacatttgcaccgaaggcgaagaccaaatcaccgtatggggcttccactccgatgacaaaacccagatgaaaaacctgtacggtgactccaaccctcagaagttcacttcttctgcgaacggcgttacgacccactacgttagccaaattggttcctttccggaccagaccgaagacggcggtctgccgcagtctggtcgtatcgtggttgattatatgatgcagaaaccgggcaaaaccggcacgatcgtttatcagcgtggtgtgctgctgccgcagaaggtttggtgcgcgtctggtcgctccaaagtaatcaaaggttcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgggtactcgtacccgcggtaaactgtgcccagattgcctgaactgcaccgacctggacgtagcactgggccgtcctatgtgcgtgggtactacgccgtctgcaaaagctagcattctgcacgaggttaaaccagtgacctccggttgctttccgattatgcatgatcgcacgaaaatccgtcagctgccgaacctgctgcgtggctacgaaaacattcgtctgtccactcagaacgttatcgacgcagaaaaagcgccgggtggcccgtaccgtctgggtacctctggtagctgcccgaacgcaacgtccaaaagcggtttcttcgcaaccatggcatgggccgttccgaaggacaacaacaaaaacgctacgaatccactgactgttgaggtgccgtacatttgcaccgaaggcgaagaccaaatcaccgtatggggcttccactccgatgacaaaacccagatgaaaaacctgtacggtgactccaaccctcagaagttcacttcttctgcgaacggcgttacgacccactacgttagccaaattggttcctttccggaccagaccgaagacggcggtctgccgcagtctggtcgtatcgtggttgattatatgatgcagaaaccgggcaaaaccggcacgatcgtttatcagcgtggtgtgctgctgccgcagaaggtttggtgcgcgtctggtcgctccaaagtaatcaaaggttagtag

SEQ ID NO: 470 - protein, 644 aa, Artificial Sequence
  STF2R3.HA1-2 (B/Fla)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 471 - protein, 883 aa, Artificial Sequence
  STF2R3.2x.HA1-2 (B/Fla)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKG

SEQ ID NO: 472 - protein, 382 aa, Artificial Sequence
  STF2delta.4xM2e (also as STF2delta.4xM2e)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLRLSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 473 - protein, 500 aa, Artificial Sequence
  STF2.D2D3L.SI (also as STF2delta.HA1-2 (SI)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLRKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 474 - protein, 642 aa, Artificial Sequence
  STF2R0.HA1-2 (PR8)
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 475 - DNA, 1935 bp, Artificial Sequence
  nucleic acid sequence for STF2R3.HA1-2 B/Fla(wild type)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctggaacaaggaccagagggaaactatgcccagactgtctcaactgcacagatctggatgtggctttgggcagaccaatgtgtgtggggaccacaccttcggcgaaagcttcaatactccacgaagtcaaacctgttacatccgggtgctttcctataatgcacgacagaacaaaaatcaggcaactacccaatcttctcagaggatatgaaaatatcaggctatcaacccaaaacgtcatcgatgcggaaaaggcaccaggaggaccctacagacttggaacctcaggatcttgccctaacgctaccagtaagagcggatttttcgcaacaatggcttgggctgtcccaaaggacaacaacaaaaatgcaacgaacccactaacagtagaagtaccatacatttgtacagaaggggaagaccaaatcactgtttgggggttccattcagatgacaaaacccaaatgaagaacctctatggagactcaaatcctcaaaagttcacctcatctgctaatggagtaaccacacactatgtttctcagattggcagcttcccagatcaaacagaagacggaggactaccacaaagcggcaggattgttgttgattacatgatgcaaaaacctgggaaaacaggaacaattgtctaccaaagaggtgttttgttgcctcaaaaggtgtggtgcgcgagtggcaggagcaaagtaataaaagggtcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttacgttag

SEQ ID NO: 476 - DNA, 717 bp, Artificial Sequence
  nucleic acid sequence for HA1-2 B/Fla (Wild type)
ggaacaaggaccagagggaaactatgcccagactgtctcaactgcacagatctggatgtggctttgggcagaccaatgtgtgtggggaccacaccttcggcgaaagcttcaatactccacgaagtcaaacctgttacatccgggtgctttcctataatgcacgacagaacaaaaatcaggcaactacccaatcttctcagaggatatgaaaatatcaggctatcaacccaaaacgtcatcgatgcggaaaaggcaccaggaggaccctacagacttggaacctcaggatcttgccctaacgctaccagtaagagcggatttttcgcaacaatggcttgggctgtcccaaaggacaacaacaaaaatgcaacgaacccactaacagtagaagtaccatacatttgtacagaaggggaagaccaaatcactgtttgggggttccattcagatgacaaaacccaaatgaagaacctctatggagactcaaatcctcaaaagttcacctcatctgctaatggagtaaccacacactatgtttctcagattggcagcttcccagatcaaacagaagacggaggactaccacaaagcggcaggattgttgttgattacatgatgcaaaaacctgggaaaacaggaacaattgtctaccaaagaggtgttttgttgcctcaaaaggtgtggtgcgcgagtggcaggagcaaagtaataaaaggg

SEQ ID NO: 477 - DNA, 2193 bp, Artificial Sequence
  STF2.HA1-2 (VN)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtagtaa

SEQ ID NO: 478 - DNA, 1890 bp, Artificial Sequence
  STF2.R3.HA1-2 PR8
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgtaataa

SEQ ID NO: 479 - DNA, 1932 bp, Artificial Sequence
  STF2.R0.HA1-2 VN
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtagtaa

SEQ ID NO: 480 - DNA, 2559 bp, Artificial Sequence
  STF2.R32x.HA1-2 VN
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtaataa

SEQ ID NO: 481 - protein, 223 aa, Artificial Sequence; identical to SEQ ID NO: 250
  HA1-2 (VN)

SEQ ID NO: 482 - DNA, 669 bp, Artificial Sequence
  HA1-2 (VN)
ggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgag

SEQ ID NO: 483 - DNA, 2241 bp, Artificial Sequence
  STF2.HA1-2 B FLA
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgggtactcgtacccgcggtaaactgtgcccagattgcctgaactgcaccgacctggacgtagcactgggccgtcctatgtgcgtgggtactacgccgtctgcaaaagctagcattctgcacgaggttaaaccagtgacctccggttgctttccgattatgcatgatcgcacgaaaatccgtcagctgccgaacctgctgcgtggctacgaaaacattcgtctgtccactcagaacgttatcgacgcagaaaaagcgccgggtggcccgtaccgtctgggtacctctggtagctgcccgaacgcaacgtccaaaagcggtttcttcgcaaccatggcatgggccgttccgaaggacaacaacaaaaacgctacgaatccactgactgttgaggtgccgtacatttgcaccgaaggcgaagaccaaatcaccgtatggggcttccactccgatgacaaaacccagatgaaaaacctgtacggtgactccaaccctcagaagttcacttcttctgcgaacggcgttacgacccactacgttagccaaattggttcctttccggaccagaccgaagacggcggtctgccgcagtctggtcgtatcgtggttgattatatgatgcagaaaccgggcaaaaccggcacgatcgtttatcagcgtggtgtgctgctgccgcagaaggtttggtgcgcgtctggtcgctccaaagtaatcaaaggttagtag

SEQ ID NO: 484 - DNA, 321 bp, Artificial Sequence
  for 4xM2e
ctgagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataataa

SEQ ID NO: 485 - protein, 105 aa, Artificial Sequence
  4xM2e protein
LSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 486 - DNA, 831 bp, Artificial Sequence
  STF2.D2D3L
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgt

SEQ ID NO: 487 - protein, 277 aa, Artificial Sequence; identical to SEQ ID NO: 15
  STF2D2D3L protein

SEQ ID NO: 488 - DNA, 1518 bp, Artificial Sequence
  fljb
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcg

SEQ ID NO: 489 - DNA, 1890 bp, Artificial Sequence
  STF2R3.HA1-2 (PR8)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctaaaggcatcgcgccgctgcagctgggtaaatgtaacattgcgggctggctgctgggtaatccggaatgcgatccgctgctgccggtccgtagctggtcttacattgttgaaactccgaactctgagaatggcatctgctacccgggcgattttatcgactatgaagaactgcgtgaacagctgtcttccgtttcttcctttgaacgtttcgaaatcttcccgaaagaaagcagctggccgaatcacaatacgaacggtgttactgctgcgtgttctcatgaaggtaaatccagcttctaccgtaacctgctgtggctgaccgaaaaagagggttcttatcctaaactgaaaaacagctacgttaacaaaaagggcaaagaagtgctggtgctgtggggtatccatcaccctccgaactctaaagaacaacagaatctgtatcagaacgaaaacgcttacgtttccgtggtgacctctaactataaccgtcgttttaccccggagattgctgaacgtccgaaagtgcgcgatcaggctggccgtatgaactactattggaccctgctgaaaccgggcgataccatcattttcgaagctaacggcaacctgattgctccgatgtatgcgtttgctctgtctcgtggcttcggctctggtattattacgtcttcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgtaataa

SEQ ID NO: 490 - DNA, 1890 bp, Artificial Sequence
  STF2R3.HA1-2 (SI)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctaaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactcttcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgtaataa

SEQ ID NO: 491 - DNA, 1839 bp, Artificial Sequence
  STF2.4xM2e
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgctgagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataataa

SEQ ID NO: 492 - DNA, 1152 bp, Artificial Sequence
  STF2.D2D3L.4xM2e
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtctgagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataataa

SEQ ID NO: 493 - DNA, 1932 bp, Artificial Sequence
  STF2.R0.HA1-2 PR8
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtaaaggcatcgcgccgctgcagctgggtaaatgtaacattgcgggctggctgctgggtaatccggaatgcgatccgctgctgccggtccgtagctggtcttacattgttgaaactccgaactctgagaatggcatctgctacccgggcgattttatcgactatgaagaactgcgtgaacagctgtcttccgtttcttcctttgaacgtttcgaaatcttcccgaaagaaagcagctggccgaatcacaatacgaacggtgttactgctgcgtgttctcatgaaggtaaatccagcttctaccgtaacctgctgtggctgaccgaaaaagagggttcttatcctaaactgaaaaacagctacgttaacaaaaagggcaaagaagtgctggtgctgtggggtatccatcaccctccgaactctaaagaacaacagaatctgtatcagaacgaaaacgcttacgtttccgtggtgacctctaactataaccgtcgttttaccccggagattgctgaacgtccgaaagtgcgcgatcaggctggccgtatgaactactattggaccctgctgaaaccgggcgataccatcattttcgaagctaacggcaacctgattgctccgatgtatgcgtttgctctgtctcgtggcttcggctctggtattattacgtcttaataa

SEQ ID NO: 494 - protein, 506 aa, Artificial Sequence; identical to SEQ ID NO: 16
  Flagellin (S. muenchen fliC)

SEQ ID NO: 495 - DNA, 1521 bp, Artificial Sequence
  Flagellin (S. muenchen fliC)
atggcacaagtcattaatacaaacagcctgtcgctgttgacccagaataacctgaacaaatcccagtccgctctgggcaccgctatcgagcgtctgtcttccggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacggtactaactcccagtctgaccttgactctatccaggctgaaatcacccagcgtctgaacgaaatcgaccgtgtatccggtcagactcagttcaacggcgtgaaagtcctggcgcaggacaacaccctgaccatccaggttggtgccaacgacggtgaaactattgatattgatttaaaagaaattagctctaaaacactgggacttgataagcttaatgtccaggatgcctacaccccgaaagaaactgctgtaaccgttgataaaactacctataaaaatggtacagatactattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttagcaactgcggaagctacagctattcggggaacggccactataacccacaaccaaattgctgaagtaacaaaagagggtgttgatacgaccacagttgcggctcaacttgctgctgcaggggttactggtgccgataaggacaatactagccttgtaaaactatcgtttgaggataaaaacggtaaggttattgatggtggctatgcagtgaaaatgggcgacgatttctatgccgctacatatgatgagaaaacaggtacaattactgctaaaacaaccacttatacagatggtgctggcgttgctcaaactggagctgtgaaatttggtggcgcaaatggtaaatctgaagttgttactgctaccgatggtaaaacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggtacagaaccgtttcaactccgctatcaccaacctgggcaataccgtaaataacctgtcttctgcccgtagccgtatcgaagattccgactacgcgaccgaagtctccaacatgtctcgcgcgcagattctgcagcaggccggtacctccgttctggcgcaggctaaccaggttccgcaaaacgtcctctctttactgcgttaa

SEQ ID NO: 496 - protein, 505 aa, Artificial Sequence
  Flagellin (S. enterica serovar dublin)
MAQVINTNSLSLLTQNNLNKSQSSLSSAIERLSSGLRINSAKDDAAGQAIANRFTSNIKGLTQASRNANDGISIAQTTEGALNEINNNLQRVRELSVQATNGTNSDSDLKSIQDEIQQRLEEIDRVSNQTQFNGVKVLSQDNQMKIQVGANDGETITIDLQKIDVKSLGLDGFNVNGPKEATVGDLKSSFKNVTGYDTYAAGADKYRVDINSGAVVTDAVAPDKVYVNAANGQLTTDDAENNTAVDLFKTTKSTAGTAEAKAIAGAIKGGKEGDTFDYKGVTFTIDTKTGDDGNGKVSTTINGEKVTLTVADIAIGAADVNAATLQSSKNVYTSVVNGQFTFDDKTKNESAKLSDLEANNAVKGESKITVNGAEYTANATGDKITLAGKTMFIDKTASGVSTLINEDAAAAKKSTANPLASIDSALSKVDAVRSSLGAIQNRFDSAITNLGNTVTNLNSARSRIEDADYATEVSNMSKAQILQQAGTSVLAQANQVPQNVLSLLR

SEQ ID NO: 497 - DNA, 1515 bp, Artificial Sequence
  Flagellin (S. enterica serovar dublin)
atggcacaagtcattaatacaaacagcctgtcgctgttgacccagaataacctgaacaaatctcagtcctcactgagttccgctattgagcgtctgtcctctggtctgcgtatcaacagcgcgaaagacgatgcggcaggccaggcgattgctaaccgcttcacttctaatatcaaaggtctgactcaggcttcccgtaacgctaacgacggcatttctattgcgcagaccactgaaggtgcgctgaatgaaatcaacaacaacctgcagcgtgtgcgtgagttgtctgttcaggccactaacgggactaactctgattccgatctgaaatctatccaggatgaaattcagcaacgtctggaagaaatcgatcgcgtttctaatcagactcaatttaacggtgttaaagtcctgtctcaggacaaccagatgaaaatccaggttggtgctaacgatggtgaaaccattaccatcgatctgcaaaaaattgatgtgaaaagccttggccttgatgggttcaatgttaatgggccaaaagaagcgacagtgggtgatctgaaatccagcttcaagaatgttacgggttacgacacctatgcagcgggtgccgataaatatcgtgtagatattaattccggtgctgtagtgactgatgcagtagcaccggataaagtatatgtaaatgcagcaaacggtcagttaacaactgacgatgcggaaaataacactgcggttgatctctttaagaccactaaatctactgctggtaccgctgaagccaaagcgatagctggtgccattaaaggtggtaaggaaggagatacctttgattataaaggcgtgacttttactattgatacaaaaactggtgatgacggtaatggtaaggtttctactaccatcaatggtgaaaaagttacgttaactgtcgctgatattgccattggcgcggcggatgttaatgctgctaccttacaatcaagcaaaaatgtttatacatctgtagtgaacggtcagtttacttttgatgataaaaccaaaaacgagagtgcgaaactttctgatttggaagcaaacaatgctgttaagggcgaaagtaaaattacagtaaatggggctgaatatactgctaacgccacgggtgataagatcaccttagctggcaaaaccatgtttattgataaaacagcttctggcgtaagtacattaatcaatgaagacgctgccgcagccaagaaaagtaccgctaacccactggcttcaattgattctgcattgtcaaaagtggacgcagttcgttcttctctgggggcaattcaaaaccgttttgattcagccattaccaaccttggcaatacggtaaccaatctgaactccgcgcgtagccgtatcgaagatgctgactatgcaacggaagtttctaatatgtctaaagcgcagattctgcagcaggctggtacttccgttctggcgcaggctaaccaggttccgcaaaacgtcctctctttactgcgt

SEQ ID NO: 498 - protein, 7 aa, Artificial Sequence
  linker
SGSGSGS

SEQ ID NO: 499 - protein, 223 aa, Artificial Sequence
  HA1-2 (SI)
KGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 500 - protein, 623 aa, Artificial Sequence
  STF2fliCR3.HA1-2 (SI)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLR

SEQ ID NO: 501 - protein, 665 aa, Artificial Sequence
  E.coliR3.HA1-2 (SI)
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSSVTMGGTTYNFKTGADAGAATANAGVSFTDTASKETVLNKVATAKQGTAVAANGDTSATITYKSGVQTYQAVFAAGDGTASAKYADNTDVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQVPQQVLSLLQG

SEQ ID NO: 502 - protein, 526 aa, Artificial Sequence
  Bacillus subtilisR3.HA1-2 (SI)
MRINHNIAALNTSRQLNAGSDSAAKNMEKLSSGLRINRAGDDAAGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGTTYTVSGKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSWADADDATNKPAGYYDAGGKVIASEKLAADSKVTKGIDISSSAKAASSALTTIKTAIDTVSSERAKLGAVQNRLEHTINNLGTSSENLTSAESRIRDVDMASEMMEYTKNNILTQASQAMLAQANQ

SEQ ID NO: 503 - protein, 846 aa, Artificial Sequence
  STF2fliCR32x.HA1-2 (VN)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 504 - protein, 851 aa, Artificial Sequence
  STF2fljBR32x.HA1-2 (SI)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 505 - protein, 888 aa, Artificial Sequence
  E.coliR32x.HA1-2 (SI)
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSSVTMGGTTYNFKTGADAGAATANAGVSFTDTASKETVLNKVATAKQGTAVAANGDTSATITYKSGVQTYQAVFAAGDGTASAKYADNTDVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQVPQQVLSLLQGKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 506 - protein, 749 aa, Artificial Sequence
  Bacillus subtilisR32x.HA1-2 (SI)
MRINHNIAALNTSRQLNAGSDSAAKNMEKLSSGLRINRAGDDAAGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGTTYTVSGKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSWADADDATNKPAGYYDAGGKVIASEKLAADSKVTKGIDISSSAKAASSALTTIKTAIDTVSSERAKLGAVQNRLEHTINNLGTSSENLTSAESRIRDVDMASEMMEYTKNNILTQASQAMLAQANQKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 507 - protein, 26 aa, Artificial Sequence
  M2e
SLLTEVETPIRNEWGSRSNDSSDPSR

SEQ ID NO: 508 - DNA, 46 bp, Artificial Sequence
  Primer
gaattccatatgagcttgctgactgaggttgagaccccgattcgca

SEQ ID NO: 509 - DNA, 67 bp, Artificial Sequence
  Primer
gacgtggctcagcttattaatggtgatgatggtgatgtctagacgggtctgagctatcgttagagcg

SEQ ID NO: 510 - protein, 10 aa, Artificial Sequence
  Linker
GAPVDPASPW

SEQ ID NO: 511 - protein, 501 aa, Artificial Sequence
  STF2deltafliC.HA1-2 (SI)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVHGAPVDPASPWTTENPLQKIDAALAQVDTLRSDLGAVQNRFNSAITNLGNTVNNLTSARSRIEDSDYATEVSNMSRAQILQQAGTSVLAQANQVPQNVLSLLRKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 512 - protein, 500 aa, Artificial Sequence; identical to SEQ ID NO: 473
  STF2deltafljB.HA1-2 (SI)

SEQ ID NO: 513 - protein, 503 aa, Artificial Sequence
  E.colidelta.HA1-2 (SI)
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNHGAPVDPASPWVTKDPLKALDEAISSIDKFRSSLGAIQNRLDSAVTNLNNTTTNLSEAQSRIQDADYATEVSNMSKAQIIQQAGNSVLAKANQVPQQVLSLLQGKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 514 - protein, 486 aa, Artificial Sequence
  Bacillus subtilisdelta.HA1-2 (SI)
MRINHNIAALNTSRQLNAGSDSAAKNMEKLSSGLRINRAGDDAAGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGHGAPVDPASPWAASSALTTIKTAIDTVSSERAKLGAVQNRLEHTINNLGTSSENLTSAESRIRDVDMASEMMEYTKNNILTQASQAMLAQANQKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 515 - protein, 631 aa, Artificial Sequence
  STF2fliCRO.HA1-2 (SI)
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 516 - protein, 642 aa, Artificial Sequence
  STF2fljBRO.HA1-2 (SI)
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 517 - protein, 730 aa, Artificial Sequence
  E. coliRO.HA1-2 (SI)
MGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDLTAAKMDAATNTITTTNNALTASKALDQLKDGDTVTIKADAAQTATVYTYNASAGNFSFSNVSNNTSAKAGDVAASLLPPAGQTASGVYKAASGEVNFDVDANGKITIGGQEAYLTSDGNLTTNDAGGATAATLDGLFKKAGDGQSIGFNKTASVTMGGTTYNFKTGADAGAATANAGVSFTDTASKETVLNKVATAKQGTAVAANGDTSATITYKSGVQTYQAVFAAGDGTASAKYADNTDVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 518 - protein, 465 aa, Artificial Sequence
  Bacillus subtilisR0.HA1-2 (SI)
MGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGTTYTVSGDQNTLTATDGSTATWADADDATNKPAGYYDAGGKVIASEKLAADSKVTKGIDISSSAKAASSALTTIKTAIDTVSSERAKLGAVQNRLEHTINNLGTSSENLTSAESRKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 519 - protein, 1032 aa, Artificial Sequence
  RSVF
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAQNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVEDKIEEILSKIYHIENEIARIKKLIGEAPGGIEGR

SEQ ID NO: 520 - protein, 26 aa, Artificial Sequence
  GCNt trimerization peptide
YIPEAPRDGZAYVRKDGEWVLLSTFL

SEQ ID NO: 521 - protein, 310 aa, Artificial Sequence
  E. coli aspartate transcarbamoylase
MANPLYQKHIISINDLSRDDLNLVLATAAKLKANPQPELLKHKVIASCFFEASTRTRLSFETSMHRLGASVVGFSDSANTSLGKKGETLADTISVISTYVDAIVMRHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLV

SEQ ID NO: 522 - protein, 499 aa, Artificial Sequence
  RSVF
QNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 523 - DNA, 1497 bp, Artificial Sequence
  RSVF
cagaacattaccgaagaattttatcagtccacgtgttccgctgtgagcaagggttatctgtccgccctgcgcaccggttggtatacctctgtaattaccattgaactgagcaacatcaaagagaacaaatgcaacggtaccgacgccaaagtgaaactgattaaacaggaactggacaaatacaaaaacgcggttacggaactgcagctgctgatgcagtctaccccggcaaccaataaccgtgctcgtcgcgaactgccgcgctttatgaactacacgctgaacaacgctaaaaagaccaatgttaccctgtctaagaaacgtaaacgtcgtttcctgggcttcctgctgggtgtaggttccgccatcgcatccggtgtggccgtgtccaaggttctgcacctggaaggtgaagtgaacaaaatcaaatccgcgctgctgtctaccaacaaggccgtagtttccctgagcaatggtgtttctgttctgacgtccaaagtactggacctgaagaactacattgataaacagctgctgccgatcgtaaacaaacagtcctgcagcatctccaacatcgaaaccgtaatcgaattccagcagaaaaacaaccgcctgctggaaatcacccgcgaattttctgtgaacgcaggcgttaccactccggtttctacctatatgctgacgaactccgaactgctgtctctgattaacgatatgccgatcactaatgatcagaagaaactgatgtctaacaatgttcagatcgttcgccagcagagctactccatcatgagcatcattaaagaggaggtgctggcttacgtagttcaactgccgctgtacggtgtaatcgataccccatgttggaaactgcacacttctccgctgtgcactactaacaccaaagagggcagcaacatctgtctgactcgcacggaccgcggctggttctgcgataacgcgggctccgtgtcctttttccctcaagccgaaacttgcaaagtgcagagcaaccgtgttttctgcgacacgatgaattctctgactctgccaagcgaagtgaacctgtgcaacgtcgacattttcaatccgaaatacgattgcaaaattatgacttccaagacggatgtgagctcctccgttattacctccctgggcgcaatcgtgtcctgctatggcaagactaaatgtactgcctctaacaaaaaccgtggcattattaaaaccttctctaacggctgtgattacgtgtctaataaaggcgtagacaccgtctctgttggtaacaccctgtactatgttaacaaacaggaaggtaagtctctgtacgtaaagggcgaaccgattattaacttctatgacccgctggtcttcccgtctgatgaattcgatgcgtctatttctcaggttaacgagaaaattaaccagtctctggcattcattcgtaaatccgacgagctgctgcataacgttaacgctggtaagtccaccactaac

SEQ ID NO: 524 - protein, 499 aa, Artificial Sequence
  RSVFmut
QNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 525 - DNA, 1497 bp, Artificial Sequence
  RSVFmut
caaaacattacggaggaattctaccagtccacctgctctgcagtctcaaagggttatttgtccgctctcaggaccggatggtacacctccgtcatcaccatcgagctgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcctcctctgaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaac

SEQ ID NO: 526 - protein, 438 aa, Artificial Sequence
  F1
FLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 527 - protein, 388 aa, Artificial Sequence
  F1
FLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 528 - protein, 111 aa, Artificial Sequence
  F2
QNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRR

SEQ ID NO: 529 - protein, 111 aa, Artificial Sequence
  F2
QNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSS

SEQ ID NO: 530 - protein, 10 aa, Artificial Sequence
  RSVF peptide (Langedijk, et al. ARch. Virol. 143: 313-320 (1998))
STNKAVVSLS

SEQ ID NO: 531 - protein, 28 aa, Artificial Sequence
  RSVF peptide (Lounsbach, et al. J. Gen. Virol. 74: 2559-65 (1993))
NDMPSIMITNDQKKLMSNNVQIVRQQSY

SEQ ID NO: 532 - protein, 142 aa, Artificial Sequence
  RSVF peptide (Werle, et al. Vaccine 17: 2983-90 (1999))
SKVLDLKNYIDKQLLPITNDQKKLMSNNVQIVRQQSYSIMSIIKEEVLAIVNKQSCSISNIETVIEFQQKNNRLLEITREFSVNAGVTTPVSTYMLTNSELLSLINDMPITNDQKKLMSNNVQIVRQQSYSIMSIIKEEVLA

SEQ ID NO: 533 - protein, 21 aa, Artificial Sequence
  RSVF peptide (Corvaisier, et al. Arch. Virol. 142: 1073-86 (1997))
PIVNKQSCSISNIETVIEFQQ

SEQ ID NO: 534 - protein, 61 aa, Artificial Sequence
  RSVF peptide (Lopez, et al. J. Gen. Virol. 74: 2567-77 (1993))
SNIETVIEFQQKNNRLLEITREFSVNAGVTTPVSTYMLTNSELLSLINDMPITNDQKKLMS

SEQ ID NO: 535 - protein, 10 aa, Artificial Sequence
  RSVF peptide (Martin-Gallardo, et al. Virology 184: 428-32 (1991))
MSIIKEEVLA

SEQ ID NO: 536 - protein, 21 aa, Artificial Sequence
  RSVF peptide (Toiron, et al. Biopolymers 39: 537-48 (1996))
SELLSLINDMPITNDQKKLMS

SEQ ID NO: 537 - protein, 50 aa, Artificial Sequence
  RSVF peptide (Ni, et al. Biochem. Biophys. Res. Com. 331: 1358-1364 (2005))
SKVLHLEGEVNKIKSALLSTNKAVVSLSNGVSVLTSKVLDLKNYIDKQLL

SEQ ID NO: 538 - protein, 21 aa, Artificial Sequence
  RSVF peptide (Bourgeois, et al. J. Gen. Virol. 72: 1051-1058 (1991))
PIVNKQSCSISNIETVIEFQQ

SEQ ID NO: 539 - protein, 20 aa, Artificial Sequence
  RSVF
SLINDMPITNDQKKLMSNNV

SEQ ID NO: 540 - protein, 8 aa, Artificial Sequence
  RSVF peptide (Arbiza, et al. J. Gen. Virol. 73: 2225-2234 (1992))
PITNDQKK

SEQ ID NO: 541 - protein, 17 aa, Artificial Sequence
  RSVF peptide (Taylor, et al. J. Gen. Viro. 73: 2217-2223 (1992))
CTASNKNRGIIKTFSNG

SEQ ID NO: 542 - protein, 104 aa, Artificial Sequence
  RSVF peptide (Singh, et al. Vaccine 25: 6211-6223 (2007))
AIVSCYGKTKCTASNKNRGIIKTFSNGCDYVSNKGVDTVSVGNTLYYVNKQEGKSLYVKGEPIINFYDPLVFPSDEFDASISQVNIRKSDELLHNVNAGKSTTN

SEQ ID NO: 543 - protein, 451 aa, Artificial Sequence
  RSVF (Parrington et al. Virus Genes 14: 63-72 (1997))
QNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIIN

SEQ ID NO: 544 - protein, 298 aa, Artificial Sequence
  RSVG
MSKNKDQRTAKTLERTWDTLNHLLFISSCLYKLNLKSVAQITLSILAMIISTSLIIAAIIFIASANHKVTPTTAIIQDATSQIKNTTPTYLTQNPQLGISPSNPSEITSQITTILASTTPGVKSTLQSTTVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKPTEEPTINTTKTNIITTLLTSNTTGNPELTSQMETFHSTSSEGNPSPSQVSTTSEYPSQPSSPPNTPRQ

SEQ ID NO: 545 - DNA, 894 bp, Artificial Sequence
  RSVG
atgtctaaaaacaaagaccaacgcaccgctaaaaccctggaacgtacttgggacacgctgaaccatctgctgttcatctctagctgcctgtataaactgaacctgaaaagcgtagcgcagattacgctgtccattctggctatgattatctctacttctctgatcatcgcggctatcatctttattgcgtctgccaaccacaaagtgactccgaccacggctatcattcaggacgcaacttctcagattaagaataccaccccgacttacctgacccagaacccgcagctgggtatctctccgagcaacccgtctgaaattacctcccagatcacgaccatcctggcatctactaccccgggtgtcaaatctaccctgcagtctaccaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccgaccgaagaaccgaccattaacactactaaaaccaacatcattacgactctgctgacctctaacaccaccggcaacccggaactgacctctcagatggaaacttttcacagcacttcctctgaaggtaacccgtctccttctcaggtttctaccacctctgaatacccgagccagccgtcctctccgcctaacaccccgcgtcag

SEQ ID NO: 546 - protein, 11 aa, Artificial Sequence
  T-cell epitope
CWAICKRIPNK

SEQ ID NO: 547 - protein, 9 aa, Artificial Sequence
  CTL epitope
NYFEWPPHA

SEQ ID NO: 548 - protein, 9 aa, Artificial Sequence
  CTL epitope
EYALGVVGV

SEQ ID NO: 549 - protein, 9 aa, Artificial Sequence
  CTL epitope
SYIGSINNI

SEQ ID NO: 550 - protein, 9 aa, Artificial Sequence
  CTL epitope
VYNTVISYI

SEQ ID NO: 551 - protein, 194 aa, Artificial Sequence
  RSV M2 protein
MSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 552 - DNA, 582 bp, Artificial Sequence
  RSV M2 protein
atgtctcgtcgtaatccgtgtaaattcgaaatccgtggtcattgtctgaacggtaaacgttgccatttcagccacaactatttcgaatggccgccacacgcgctgctggtccgtcagaactttatgctgaatcgtatcctgaagtccatggataaatctatcgacactctgtctgaaatcagcggcgctgctgaactggatcgtacggaagaatatgctctgggtgttgtgggtgtcctggaaagctacatcggctccatcaacaacattaccaaacagtctgcttgtgttgcgatgagcaagctgctgaccgaactgaacagcgacgacatcaaaaagctgcgtgataacgaggaactgaactctccgaaaattcgtgtctacaacactgtcatttcttatattgaaagcaaccgtaaaaataataaacagactatccatctgctgaaacgtctgccggctgatgtgctgaaaaagactatcaaaaacaccctggacatccataaaagcattactatcaacaacccgaaagaaagcacggtgtccgatactaacgatcacgccaaaaacaatgataccacc

SEQ ID NO: 553 - protein, 1005 aa, Artificial Sequence
  STF2.RSVF(26-524)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAQNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 554 - DNA, 3015 bp, Artificial Sequence
  STF2.RSVF(26-524)
atggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcacaaaacattacggaggaattctaccagtccacctgctctgcagtctcaaagggttatttgtccgctctcaggaccggatggtacacctccgtcatcaccatcgagctgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcctcctctgaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaac

SEQ ID NO: 555 - protein, 921 aa, Artificial Sequence
  STF2.RSVF(110-524)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 556 - DNA, 2763 bp, Artificial Sequence
  STF2.RSVF(110-524)
atggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcagaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaac

SEQ ID NO: 557 - protein, 894 aa, Artificial Sequence
  STF2.RSVF(137-524)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTN

SEQ ID NO: 558 - DNA, 2682 bp, Artificial Sequence
  STF2.RSVF(137-524)
atggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcattcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaac

SEQ ID NO: 559 - protein, 1005 aa, Artificial Sequence
  RSVF(26-524).STF2
MQNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 560 - DNA, 3015 bp, Artificial Sequence
  RSVF(26-524).STF2
atgcaaaacattacggaggaattctaccagtccacctgctctgcagtctcaaagggttatttgtccgctctcaggaccggatggtacacctccgtcatcaccatcgagctgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcctcctctgaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaacgcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagca

SEQ ID NO: 561 - protein, 921 aa, Artificial Sequence
  RSVF(110-524).STF2
MELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 562 - DNA, 2763 bp, Artificial Sequence
  RSVF(110-524).STF2
atggaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaacgcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagca

SEQ ID NO: 563 - protein, 894 aa, Artificial Sequence
  RSVF(137-524).STF2
MFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 564 - DNA, 2682 bp, Artificial Sequence
  RSVF(137-524).STF2
atgttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaacgcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagca

SEQ ID NO: 565 - protein, 1032 aa, Artificial Sequence; identical to SEQ ID NO: 519
  STF2.RSVF-GCNt

SEQ ID NO: 566 - DNA, 3096 bp, Artificial Sequence
  STF2.RSVF-GCNt
atggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcacaaaacattacggaggaattctaccagtccacctgctctgcagtctcaaagggttatttgtccgctctcaggaccggatggtacacctccgtcatcaccatcgagctgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcctcctctgaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtggaagacaaaatagaagaaatcctcagcaagatctaccacatcgagaacgaaatcgccaggattaagaaactgattggtgaggcacctggtggtatcgagggaagg

SEQ ID NO: 567 - protein, 1032 aa, Artificial Sequence
  RSVF-GCNt.STF2
MQNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVEDKIEEILSKIYHIENEIARIKKLIGEAPGGIEGRAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 568 - DNA, 3096 bp, Artificial Sequence
  RSVF-GCNt.STF2
atgcaaaacattacggaggaattctaccagtccacctgctctgcagtctcaaagggttatttgtccgctctcaggaccggatggtacacctccgtcatcaccatcgagctgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcctcctctgaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtggaagacaaaatagaagaaatcctcagcaagatctaccacatcgagaacgaaatcgccaggattaagaaactgattggtgaggcacctggtggtatcgagggaagggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagca

SEQ ID NO: 569 - protein, 803 aa, Artificial Sequence
  STF2.RSVG(1-298)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASKNKDQRTAKTLERTWDTLNHLLFISSCLYKLNLKSVAQITLSILAMIISTSLIIAAIIFIASANHKVTPTTAIIQDATSQIKNTTPTYLTQNPQLGISPSNPSEITSQITTILASTTPGVKSTLQSTTVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKPTEEPTINTTKTNIITTLLTSNTTGNPELTSQMETFHSTSSEGNPSPSQVSTTSEYPSQPSSPPNTPRQ

SEQ ID NO: 570 - DNA, 2409 bp, Artificial Sequence
  STF2.RSVG(1-298)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgtctaaaaacaaagaccaacgcaccgctaaaaccctggaacgtacttgggacacgctgaaccatctgctgttcatctctagctgcctgtataaactgaacctgaaaagcgtagcgcagattacgctgtccattctggctatgattatctctacttctctgatcatcgcggctatcatctttattgcgtctgccaaccacaaagtgactccgaccacggctatcattcaggacgcaacttctcagattaagaataccaccccgacttacctgacccagaacccgcagctgggtatctctccgagcaacccgtctgaaattacctcccagatcacgaccatcctggcatctactaccccgggtgtcaaatctaccctgcagtctaccaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccgaccgaagaaccgaccattaacactactaaaaccaacatcattacgactctgctgacctctaacaccaccggcaacccggaactgacctctcagatggaaacttttcacagcacttcctctgaaggtaacccgtctccttctcaggtttctaccacctctgaatacccgagccagccgtcctctccgcctaacaccccgcgtcag

SEQ ID NO: 571 - protein, 739 aa, Artificial Sequence
  STF2.RSVG(66-298)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLANHKVTPTTAIIQDATSQIKNTTPTYLTQNPQLGISPSNPSEITSQITTILASTTPGVKSTLQSTTVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKPTEEPTINTTKTNIITTLLTSNTTGNPELTSQMETFHSTSSEGNPSPSQVSTTSEYPSQPSSPPNTPRQ

SEQ ID NO: 572 - DNA, 2217 bp, Artificial Sequence
  STF2.RSVG(66-298)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgaaccacaaagtgactccgaccacggctatcattcaggacgcaacttctcagattaagaataccaccccgacttacctgacccagaacccgcagctgggtatctctccgagcaacccgtctgaaattacctcccagatcacgaccatcctggcatctactaccccgggtgtcaaatctaccctgcagtctaccaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccgaccgaagaaccgaccattaacactactaaaaccaacatcattacgactctgctgacctctaacaccaccggcaacccggaactgacctctcagatggaaacttttcacagcacttcctctgaaggtaacccgtctccttctcaggtttctaccacctctgaatacccgagccagccgtcctctccgcctaacaccccgcgtcag

SEQ ID NO: 573 - protein, 607 aa, Artificial Sequence
  STF2.RSVG(130-230)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLATVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKP

SEQ ID NO: 574 - DNA, 1821 bp, Artificial Sequence
  STF2.RSVG(130-230)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccg

SEQ ID NO: 575 - protein, 699 aa, Artificial Sequence
  STF2.RSVM2(1-194)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 576 - DNA, 2097 bp, Artificial Sequence
  STF2.RSVM2(1-194)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgtctcgtcgtaatccgtgtaaattcgaaatccgtggtcattgtctgaacggtaaacgttgccatttcagccacaactatttcgaatggccgccacacgcgctgctggtccgtcagaactttatgctgaatcgtatcctgaagtccatggataaatctatcgacactctgtctgaaatcagcggcgctgctgaactggatcgtacggaagaatatgctctgggtgttgtgggtgtcctggaaagctacatcggctccatcaacaacattaccaaacagtctgcttgtgttgcgatgagcaagctgctgaccgaactgaacagcgacgacatcaaaaagctgcgtgataacgaggaactgaactctccgaaaattcgtgtctacaacactgtcatttcttatattgaaagcaaccgtaaaaataataaacagactatccatctgctgaaacgtctgccggctgatgtgctgaaaaagactatcaaaaacaccctggacatccataaaagcattactatcaacaacccgaaagaaagcacggtgtccgatactaacgatcacgccaaaaacaatgataccacc

SEQ ID NO: 577 - protein, 499 aa, Artificial Sequence; identical to SEQ ID NO: 522
  Human RSV strain A2

SEQ ID NO: 578 - protein, 499 aa, Artificial Sequence
  Human RSV strain 9320
QNITEEFYQSTCSAVSRGYFSALRTGWYTSVITIELSNIKETKCNGTDTKVKLIKQELDKYKNAVTELQLLTQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKSYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTN

SEQ ID NO: 579 - protein, 499 aa, Artificial Sequence
  Bovine RSV strain Tue 51980
QNITEEFYQSTCSAVSRGYLSALRTGWYTSVVTIELSKIQKNVCKSTDSKVKLIKQELERYNNAVVELQSLMQNEPASFSRAKRGIPELIHYTRNSTKKFYGLMGKKRKRRFLGFLLGIGSAVASGVAVSKVLHLEGEVNKIKNALLSTNKAVVSLSNGVSVLTSKVLDLKNYIDKELLPQVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQTETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTN

SEQ ID NO: 580 - protein, 247 aa, Artificial Sequence
  RSVF(234-480)
TREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDP

SEQ ID NO: 581 - DNA, 741 bp, Artificial Sequence
  RSVF(234-480)
accagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcct

SEQ ID NO: 582 - protein, 267 aa, Artificial Sequence
  RSVF(26-60,234-458)
QNITEEFYQSTCSAVSKGYLSALRTGWYTSVITIEGSGSGSGTREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYY

SEQ ID NO: 583 - DNA, 801 bp, Artificial Sequence
  RSVF(26-60,234-458)
caaaacattacggaggaattctaccagtccacctgctctgcagtctcaaagggttatttgtccgctctcaggaccggatggtacacctccgtcatcaccatcgagggttctggttctggttctggtaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactac

SEQ ID NO: 584 - protein, 1100 aa, Artificial Sequence
  RSVF(26-523)wt+HRA/HRB.STF2
QNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAHLEGEVNKIKSALLSTNKAVVSLSNGVSVLTSKVLDLKNYIDKQLLPIVNGSGSGDPLVFPSDEFDASISQVNEKINQSLAFIRKSDELLHNVNAGKSTTNMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 585 - DNA, 3300 bp, Artificial Sequence
  RSVF(26-523) wt+HRA/HRB.STF2
caaaacattacggaggaattctaccagtccacctgctctgcagtctcaaagggttatttgtccgctctcaggaccggatggtacacctccgtcatcaccatcgaactgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcccgtcgcgaacttcctcgcttcatgaactacaccctgaacaatgcaaagaagaccaacgttacgctttcaaagaagcgtaagcgccgcttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcttctatctcccaagtcaacgaaaagatcaaccagagccttgcttttattcgtaagagcgacgagttgctccacaacgtgaacgctcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacggttctggttctggtgatcctcttgtgttcccctctgacgagttcgacgcttctatctcccaagtcaacgaaaagatcaaccagagccttgcttttattcgtaagagcgacgagttgctccacaacgtgaacgctggaaagtcgactacaaacatggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctgctgcgt

SEQ ID NO: 586 - protein, 511 aa, Artificial Sequence
  RSVF(26-480)
QNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPAVSKVLHLEGEVNKIKSALLSTNKAVVSLSNGVSVLTSKVLDLKNYIDKQLLPIVN

SEQ ID NO: 587 - DNA, 1533 bp, Artificial Sequence
  RSVF(26-480)
caaaacattacggaggaattctaccagtccacctgctctgcagtctcaaagggttatttgtccgctctcaggaccggatggtacacctccgtcatcaccatcgaactgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcccgtcgcgaacttcctcgcttcatgaactacaccctgaacaatgcaaagaagaccaacgttacgctttcaaagaagcgtaagcgccgcttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctgccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaac

SEQ ID NO: 588 - protein, 1068 aa, Artificial Sequence
  RSVF(26-480)wt+2xHRA.STF2
QNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPAVSKVLHLEGEVNKIKSALLSTNKAVVSLSNGVSVLTSKVLDLKNYIDKQLLPIVNAHLEGEVNKIKSALLSTNKAVVSLSNGVSVLTSKVLDLKNYIDKQLLPIVNMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 589 - DNA, 3204 bp, Artificial Sequence
  RSVF(26-522)wt+2xHRA.STF2
caaaacattacggaggaattctaccagtccacctgctctgcagtctcaaagggttatttgtccgctctcaggaccggatggtacacctccgtcatcaccatcgaactgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcccgtcgcgaacttcctcgcttcatgaactacaccctgaacaatgcaaagaagaccaacgttacgctttcaaagaagcgtaagcgccgcttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctgccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacgctcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacatggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctgctgcgt

SEQ ID NO: 590 - protein, 1032 aa, Artificial Sequence
  RSVF(26-522)wt+GCNt.STF2
QNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVEDKIEEILSKIYHIENEIARIKKLIGEAPGGIEGRMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 591 - DNA, 3096 bp, Artificial Sequence
  RSVF(26-522)wt+GCNt.STF2
caaaacattacggaggaattctaccagtccacctgctctgcagtctcaaagggttatttgtccgctctcaggaccggatggtacacctccgtcatcaccatcgaactgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcccgtcgcgaacttcctcgcttcatgaactacaccctgaacaatgcaaagaagaccaacgttacgctttcaaagaagcgtaagcgccgcttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcttctatctcccaagtcaacgaaaagatcaaccagagccttgcttttattcgtaagagcgacgagttgctccacaacgtggaagacaaaatagaagaaatcctcagcaagatctaccacatcgagaacgaaatcgccaggattaagaaactgattggtgaggcacctggtggtatcgagggaaggatggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctgctgcgt

SEQ ID NO: 592 - protein, 755 aa, Artificial Sequence
  STF2.RSVF(DIII)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRTGWYTSVITIELSNIKETKCNGTDTKVKLIKQELDKYKNAVTELQLLMQNTPAANNRASSEAPQYMNYTINTTKNLNVSISKKRKSSFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLA

SEQ ID NO: 593 - DNA, 2259 bp, Artificial Sequence
  STF2.RSVF(DIII)
atggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctgctgcgtaccggatggtacacctccgtcatcaccatcgaactgagcaacatcaaggagaacaagtgtaatggaaccgacgctaaggtgaaattgatcaaacaggagctggacaaatataagaacgccgtaactgagctgcagcttctcatgcagtccacacccgctacgaacaacagggcctcctctgaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtg

SEQ ID NO: 594 - protein, 755 aa, Artificial Sequence
  STF2.RSVF(DIII)mut
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRTGWYTSVITIELSNIKETKCNGTDTKVKLIKQELDKYKNAVTELQLLMQNTPAANNRASSEAPQYMNYTINTTKNLNVSISKKRKSSFLGFLLGVGSAIASGILVSKLLHLEGEVNKIKNALLSTNKAVVSLSNGVSVLTSKVLCLKNYINNQLLPIVNQQSCRISNIETVIEFQQKNSRLLEINREFSVLAGVTTPLSTYMLTNCELLSLINDMPITNDQKKLMSSNVQILRQQSYSIMSIIKEEVLA

SEQ ID NO: 595 - protein, 755 aa, Artificial Sequence
  RSVF(DIII).STF2
TGWYTSVITIELSNIKETKCNGTDTKVKLIKQELDKYKNAVTELQLLMQNTPAANNRASSEAPQYMNYTINTTKNLNVSISKKRKSSFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 596 - protein, 755 aa, Artificial Sequence
  RSVF(DIII)mut.STF2
TGWYTSVITIELSNIKETKCNGTDTKVKLIKQELDKYKNAVTELQLLMQNTPAANNRASSEAPQYMNYTINTTKNLNVSISKKRKSSFLGFLLGVGSAIASGILVSKLLHLEGEVNKIKNALLSTNKAVVSLSNGVSVLTSKVLCLKNYINNQLLPIVNQQSCRISNIETVIEFQQKNSRLLEINREFSVLAGVTTPLSTYMLTNCELLSLINDMPITNDQKKLMSSNVQILRQQSYSIMSIIKEEVLAMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 597 - protein, 932 aa, Artificial Sequence
  STF2.RSVG(66-298).RSVM2(1-194)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLANHKVTPTTAIIQDATSQIKNTTPTYLTQNPQLGISPSNPSEITSQITTILASTTPGVKSTLQSTTVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKPTEEPTINTTKTNIITTLLTSNTTGNPELTSQMETFHSTSSEGNPSPSQVSTTSEYPSQPSSPPNTPRQSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 598 - DNA, 2796 bp, Artificial Sequence
  STF2.RSVG(66-298).RSVM2(1-194)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgaaccacaaagtgactccgaccacggctatcattcaggacgcaacttctcagattaagaataccaccccgacttacctgacccagaacccgcagctgggtatctctccgagcaacccgtctgaaattacctcccagatcacgaccatcctggcatctactaccccgggtgtcaaatctaccctgcagtctaccaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccgaccgaagaaccgaccattaacactactaaaaccaacatcattacgactctgctgacctctaacaccaccggcaacccggaactgacctctcagatggaaacttttcacagcacttcctctgaaggtaacccgtctccttctcaggtttctaccacctctgaatacccgagccagccgtcctctccgcctaacaccccgcgtcagtctcgtcgtaatccgtgtaaattcgaaatccgtggtcattgtctgaacggtaaacgttgccatttcagccacaactatttcgaatggccgccacacgcgctgctggtccgtcagaactttatgctgaatcgtatcctgaagtccatggataaatctatcgacactctgtctgaaatcagcggcgctgctgaactggatcgtacggaagaatatgctctgggtgttgtgggtgtcctggaaagctacatcggctccatcaacaacattaccaaacagtctgcttgtgttgcgatgagcaagctgctgaccgaactgaacagcgacgacatcaaaaagctgcgtgataacgaggaactgaactctccgaaaattcgtgtctacaacactgtcatttcttatattgaaagcaaccgtaaaaataataaacagactatccatctgctgaaacgtctgccggctgatgtgctgaaaaagactatcaaaaacaccctggacatccataaaagcattactatcaacaacccgaaagaaagcacggtgtccgatactaacgatcacgccaaaaacaatgataccacc

SEQ ID NO: 599 - protein, 932 aa, Artificial Sequence
  STF2.RSVM2(1-194).RSVG(66-298)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTTNHKVTPTTAIIQDATSQIKNTTPTYLTQNPQLGISPSNPSEITSQITTILASTTPGVKSTLQSTTVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKPTEEPTINTTKTNIITTLLTSNTTGNPELTSQMETFHSTSSEGNPSPSQVSTTSEYPSQPSSPPNTPRQ

SEQ ID NO: 600 - DNA, 2796 bp, Artificial Sequence
  STF2.RSVM2(1-194).RSVG(166-298)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgtctcgtcgtaatccgtgtaaattcgaaatccgtggtcattgtctgaacggtaaacgttgccatttcagccacaactatttcgaatggccgccacacgcgctgctggtccgtcagaactttatgctgaatcgtatcctgaagtccatggataaatctatcgacactctgtctgaaatcagcggcgctgctgaactggatcgtacggaagaatatgctctgggtgttgtgggtgtcctggaaagctacatcggctccatcaacaacattaccaaacagtctgcttgtgttgcgatgagcaagctgctgaccgaactgaacagcgacgacatcaaaaagctgcgtgataacgaggaactgaactctccgaaaattcgtgtctacaacactgtcatttcttatattgaaagcaaccgtaaaaataataaacagactatccatctgctgaaacgtctgccggctgatgtgctgaaaaagactatcaaaaacaccctggacatccataaaagcattactatcaacaacccgaaagaaagcacggtgtccgatactaacgatcacgccaaaaacaatgataccaccaaccacaaagtgactccgaccacggctatcattcaggacgcaacttctcagattaagaataccaccccgacttacctgacccagaacccgcagctgggtatctctccgagcaacccgtctgaaattacctcccagatcacgaccatcctggcatctactaccccgggtgtcaaatctaccctgcagtctaccaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccgaccgaagaaccgaccattaacactactaaaaccaacatcattacgactctgctgacctctaacaccaccggcaacccggaactgacctctcagatggaaacttttcacagcacttcctctgaaggtaacccgtctccttctcaggtttctaccacctctgaatacccgagccagccgtcctctccgcctaacaccccgcgtcag

SEQ ID NO: 601 - protein, 800 aa, Artificial Sequence
  STF2.RSVG(130-230).RSVM2(1-194)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLATVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKPSRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 602 - DNA, 2400 bp, Artificial Sequence
  STF2.RSVG(130-230).RSVM2 (1-194)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccgtctcgtcgtaatccgtgtaaattcgaaatccgtggtcattgtctgaacggtaaacgttgccatttcagccacaactatttcgaatggccgccacacgcgctgctggtccgtcagaactttatgctgaatcgtatcctgaagtccatggataaatctatcgacactctgtctgaaatcagcggcgctgctgaactggatcgtacggaagaatatgctctgggtgttgtgggtgtcctggaaagctacatcggctccatcaacaacattaccaaacagtctgcttgtgttgcgatgagcaagctgctgaccgaactgaacagcgacgacatcaaaaagctgcgtgataacgaggaactgaactctccgaaaattcgtgtctacaacactgtcatttcttatattgaaagcaaccgtaaaaataataaacagactatccatctgctgaaacgtctgccggctgatgtgctgaaaaagactatcaaaaacaccctggacatccataaaagcattactatcaacaacccgaaagaaagcacggtgtccgatactaacgatcacgccaaaaacaatgataccacc

SEQ ID NO: 603 - protein, 800 aa, Artificial Sequence
  STF2.RSVM2(1-194).RSVG (130-230)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTTTVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKP

SEQ ID NO: 604 - DNA, 2400 bp, Artificial Sequence
  STF2.RSVM2(1-194).RSVG(130-230)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgtctcgtcgtaatccgtgtaaattcgaaatccgtggtcattgtctgaacggtaaacgttgccatttcagccacaactatttcgaatggccgccacacgcgctgctggtccgtcagaactttatgctgaatcgtatcctgaagtccatggataaatctatcgacactctgtctgaaatcagcggcgctgctgaactggatcgtacggaagaatatgctctgggtgttgtgggtgtcctggaaagctacatcggctccatcaacaacattaccaaacagtctgcttgtgttgcgatgagcaagctgctgaccgaactgaacagcgacgacatcaaaaagctgcgtgataacgaggaactgaactctccgaaaattcgtgtctacaacactgtcatttcttatattgaaagcaaccgtaaaaataataaacagactatccatctgctgaaacgtctgccggctgatgtgctgaaaaagactatcaaaaacaccctggacatccataaaagcattactatcaacaacccgaaagaaagcacggtgtccgatactaacgatcacgccaaaaacaatgataccaccaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccg

SEQ ID NO: 605 - protein, 1032 aa, Artificial Sequence
  RSVF(26-522)+GCNt.STF2
QNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVEDKIEEILSKIYHIENEIARIKKLIGEAPGGIEGRMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 606 - protein, 1100 aa, Artificial Sequence
  RSVF(26-523)+HRA/HRB.STF2
QNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAHLEGEVNKIKSALLSTNKAVVSLSNGVSVLTSKVLDLKNYIDKQLLPIVNGSGSGDPLVFPSDEFDASISQVNEKINQSLAFIRKSDELLHNVNAGKSTTNMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 607 - protein, 1068 aa, Artificial Sequence
  RSVF(26-480)+2xHRA.STF2
QNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPAVSKVLHLEGEVNKIKSALLSTNKAVVSLSNGVSVLTSKVLDLKNYIDKQLLPIVNAHLEGEVNKIKSALLSTNKAVVSLSNGVSVLTSKVLDLKNYIDKQLLPIVNMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 608 - protein, 812 aa, Artificial Sequence
  STF2.4xRSVF(397-464).His6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRGSGSGSGTSKTDVSSSVITSLGAIVSCYGKTKCTASNKNRGIIKTFSNGCDYVSNKGVDTVSVGNTLYYVNKQEGGSGSGSGTSKTDVSSSVITSLGAIVSCYGKTKCTASNKNRGIIKTFSNGCDYVSNKGVDTVSVGNTLYYVNKQEGGSGSGSGTSKTDVSSSVITSLGAIVSCYGKTKCTASNKNRGIIKTFSNGCDYVSNKGVDTVSVGNTLYYVNKQEGGSGSGSGTSKTDVSSSVITSLGAIVSCYGKTKCTASNKNRGIIKTFSNGCDYVSNKGVDTVSVGNTLYYVNKQEGHHHHHH

SEQ ID NO: 609 - protein, 812 aa, Artificial Sequence
  STF2.4xRSVF(397-464)deltCys439Ser.His6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRGSGSGSGTSKTDVSSSVITSLGAIVSCYGKTKCTASNKNRGIIKTFSNGSDYVSNKGVDTVSVGNTLYYVNKQEGGSGSGSGTSKTDVSSSVITSLGAIVSCYGKTKCTASNKNRGIIKTFSNGSDYVSNKGVDTVSVGNTLYYVNKQEGGSGSGSGTSKTDVSSSVITSLGAIVSCYGKTKCTASNKNRGIIKTFSNGSDYVSNKGVDTVSVGNTLYYVNKQEGGSGSGSGTSKTDVSSSVITSLGAIVSCYGKTKCTASNKNRGIIKTFSNGSDYVSNKGVDTVSVGNTLYYVNKQEGHHHHHH

SEQ ID NO: 610 - protein, 764 aa, Artificial Sequence
  STF2.4xRSVF(232-287).His6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRGSGSGSGEITREFSVNAGVTTPVSTYMLTNSELLSLINDMPITNDQKKLMSNNVQIVRQQSYSGSGSGSGEITREFSVNAGVTTPVSTYMLTNSELLSLINDMPITNDQKKLMSNNVQIVRQQSYSGSGSGSGEITREFSVNAGVTTPVSTYMLTNSELLSLINDMPITNDQKKLMSNNVQIVRQQSYSGSGSGSGEITREFSVNAGVTTPVSTYMLTNSELLSLINDMPITNDQKKLMSNNVQIVRQQSYSHHHHHH

SEQ ID NO: 611 - protein, 574 aa, Artificial Sequence
  RSVF
MELLIHRLSAIFLTLAINALYLTSSQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVVLLSLIAIGLLLYCKAKNTPVTLSKDGLSGINNIAFSK

SEQ ID NO: 612 - protein, 574 aa, Artificial Sequence
  RSVF mutant
MELLIHRLSAIFLTLAINALYLTSSQNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVVLLSLIAIGLLLYCKAKNTPVTLSKDGLSGINNIAFSK

SEQ ID NO: 613 - protein, 506 aa, Artificial Sequence
  STF2ng non-glycosylated STF2
MAQVINTNSLSLLTQNNLQKSQSALGTAIERLSSGLRINSAKDDAAGQAIANRFTANIKGLTQASRNANDGISIAQTTEGALNEINNNLQRVRELAVQSAQSTNSQSDLDSIQAEITQRLNEIDRVSGQTQFNGVKVLAQDNTLTIQVGANDGETIDIDLKQINSQTLGLDSLNVQKAYDVKDTAVTTKAYANQGTTLDVSGLDDAAIKAATGGTQGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYQASKAAGHDFKAQPELAEAAAKTTENPLQKIDAALAQVDALRSDLGAVQNRFNSAITNLGNTVNQLSEARSRIEDSDYATEVSQMSRAQILQQAGTSVLAQANQVPQNVLSLLA

SEQ ID NO: 614 - DNA, 1518 bp, Artificial Sequence
  STF2ng non-glycosylated STF2
atggcccaggttatcaataccaactccctgtcgttgctcacccaaaataaccttcaaaaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgcccagtcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaaccaaggcactaccttggatgtgagcggattggatgatgcagcaatcaaggctgctaccggcggtacgcagggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacataccaagcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaaccagctatccgaggccagatcccgcattgaagactccgactacgcgacagaagtaagtcaaatgagtcgtgcccagattctgcagcaggccggcactagtgtcctggcccaggccaatcaagtcccgcagaatgtgctgagcctactagca

SEQ ID NO: 615 - protein, 1011 aa, Artificial Sequence
  STF2ng non-glycosylated STF2
MQNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNAQVINTNSLSLLTQNNLQKSQSALGTAIERLSSGLRINSAKDDAAGQAIANRFTANIKGLTQASRNANDGISIAQTTEGALNEINNNLQRVRELAVQSAQSTNSQSDLDSIQAEITQRLNEIDRVSGQTQFNGVKVLAQDNTLTIQVGANDGETIDIDLKQINSQTLGLDSLNVQKAYDVKDTAVTTKAYANQGTTLDVSGLDDAAIKAATGGTQGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYQASKAAGHDFKAQPELAEAAAKTTENPLQKIDAALAQVDALRSDLGAVQNRFNSAITNLGNTVNQLSEARSRIEDSDYATEVSQMSRAQILQQAGTSVLAQANQVPQNVLSLLAHHHHHH

SEQ ID NO: 616 - DNA, 3033 bp, Artificial Sequence
  RSVF.STF2ngHis6
atgcaaaacattacggaggaattctaccagtccacctgctctgcagtctcaaagggttatttgtccgctctcaggaccggatggtacacctccgtcatcaccatcgagctgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcctcctctgaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaacgcccaggttatcaataccaactccctgtcgttgctcacccaaaataaccttcaaaaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgcccagtcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaaccaaggcactaccttggatgtgagcggattggatgatgcagcaatcaaggctgctaccggcggtacgcagggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacataccaagcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaaccagctatccgaggccagatcccgcattgaagactccgactacgcgacagaagtaagtcaaatgagtcgtgcccagattctgcagcaggccggcactagtgtcctggcccaggccaatcaagtcccgcagaatgtgctgagcctactacgacaucaccaucaccaucac

SEQ ID NO: 617 - protein, 506 aa, Artificial Sequence
  RSVF.STF2ngHis6
MQNITEEFYQSTCSAVSKGYLSALRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNHHHHHH

SEQ ID NO: 618 - DNA, 1515 bp, Artificial Sequence
  RSVFHis6
atgcaaaacattacggaggaattctaccagtccacctgctctgcagtctcaaagggttatttgtccgctctcaggaccggatggtacacctccgtcatcaccatcgagctgagcaacatcaaggagaacaagtgtaatggaaccgacgctaaggtgaaattgatcaaacaggagctggacaaatataagaacgccgtaactgagctgcagcttctcatgcagtcgacacccgctacgaacaacagggcctcctctgaacttcctcgcttcatgaactacaccctgaacaatgcaaagaagaccaacgttacgctttcaaagaagcgtaagtcctctttcttgggattcctgctgggagtgggctccgctattgccagcggagtagccgtgagtaaagtgcttcatttggagggtgaagtaaacaagattaagtccgccctgctttccactaacaaggcggtcgtaagcctgtccaatggtgtgagcgtgctcacgagtaaagtactggacctcaagaattacattgacaagcaactgctgcccatcgtcaacaagcagagctgctccatctcgaacatcgaaactgtaattgagttccaacagaagaacaaccgcttgcttgagatcaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctcttgtgttcccctctgacgagttcgacgcgtctatctcccaagtcaacgaaaagatcaaccagagccttgcttttattcgtaagagcgacgagttgctccacaacgtgaacgctggaaagtcgactacaaaccaccaucaccaucac

SEQ ID NO: 619 - protein, 277 aa, Artificial Sequence
  RSVFHis6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 620 - DNA, 831 bp, Artificial Sequence
  STF2delta
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttagca

SEQ ID NO: 621 - protein, 378 aa, Artificial Sequence
  STF2delta
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLATVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKP

SEQ ID NO: 622 - DNA, 1134 bp, Artificial Sequence
  STF2delta.RSVG(66-298)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttagcaaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccg

SEQ ID NO: 623 - protein, 510 aa, Artificial Sequence
  STF2delta.RSVG(66-298)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLANHKVTPTTAIIQDATSQIKNTTPTYLTQNPQLGISPSNPSEITSQITTILASTTPGVKSTLQSTTVKTKNTTTTQTQPSKPTTKQRQNKPPSKPNNDFHFEVFNFVPCSICSNNPTCWAICKRIPNKKPGKKTTTKPTKKPTLKTTKKDPKPQTTKSKEVPTTKPTEEPTINTTKTNIITTLLTSNTTGNPELTSQMETFHSTSSEGNPSPSQVSTTSEYPSQPSSPPNTPRQ

SEQ ID NO: 624 - DNA, 1530 bp, Artificial Sequence
  STF2delta.RSVG(66-298)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttagcaaaccacaaagtgactccgaccacggctatcattcaggacgcaacttctcagattaagaataccaccccgacttacctgacccagaacccgcagctgggtatctctccgagcaacccgtctgaaattacctcccagatcacgaccatcctggcatctactaccccgggtgtcaaatctaccctgcagtctaccaccgttaagacgaaaaacactactaccacccagactcaaccgtccaaacctaccaccaaacagcgtcagaataaacctccgtccaaaccgaacaatgatttccactttgaagtgtttaacttcgtaccgtgttctatttgttctaataacccgacctgctgggctatctgcaaacgtattccaaacaaaaagcctggcaaaaagaccactaccaaaccgaccaaaaagccgaccctgaagactactaagaaggacccgaaaccgcagacgaccaaatccaaagaagttccaaccacgaaaccgaccgaagaaccgaccattaacactactaaaaccaacatcattacgactctgctgacctctaacaccaccggcaacccggaactgacctctcagatggaaacttttcacagcacttcctctgaaggtaacccgtctccttctcaggtttctaccacctctgaatacccgagccagccgtcctctccgcctaacaccccgcgtcag

SEQ ID NO: 625 - protein, 470 aa, Artificial Sequence
  STF2delta.RSVM2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLASRRNPCKFEIRGHCLNGKRCHFSHNYFEWPPHALLVRQNFMLNRILKSMDKSIDTLSEISGAAELDRTEEYALGVVGVLESYIGSINNITKQSACVAMSKLLTELNSDDIKKLRDNEELNSPKIRVYNTVISYIESNRKNNKQTIHLLKRLPADVLKKTIKNTLDIHKSITINNPKESTVSDTNDHAKNNDTT

SEQ ID NO: 626 - DNA, 1410 bp, Artificial Sequence
  STF2delta.RSVM2
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttagcatctcgtcgtaatccgtgtaaattcgaaatccgtggtcattgtctgaacggtaaacgttgccatttcagccacaactatttcgaatggccgccacacgcgctgctggtccgtcagaactttatgctgaatcgtatcctgaagtccatggataaatctatcgacactctgtctgaaatcagcggcgctgctgaactggatcgtacggaagaatatgctctgggtgttgtgggtgtcctggaaagctacatcggctccatcaacaacattaccaaacagtctgcttgtgttgcgatgagcaagctgctgaccgaactgaacagcgacgacatcaaaaagctgcgtgataacgaggaactgaactctccgaaaattcgtgtctacaacactgtcatttcttatattgaaagcaaccgtaaaaataataaacagactatccatctgctgaaacgtctgccggctgatgtgctgaaaaagactatcaaaaacaccctggacatccataaaagcattactatcaacaacccgaaagaaagcacggtgtccgatactaacgatcacgccaaaaacaatgataccacc

SEQ ID NO: 627 - protein, 26 aa, Artificial Sequence
  RSVG
HPEVFNFVPCSICSNNPTCWAICKRI

SEQ ID NO: 628 - protein, 401 aa, Artificial Sequence
  STF2delta.DEN1EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGK

SEQ ID NO: 629 - DNA, 1203 bp, Artificial Sequence
  STF2delta.DEN1EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcatggacaaattgacgcttaagggaatgagttatgtaatgtgtactggatcatttaagttagagaaagaagttgcagagacgcagcatggcacggtcctagtacaagtgaaatatgagggtacagacgctccgtgcaaaattccattctccactcaggatgagaagggggcgacacaaaatgggagactcattaccgcgaatccaatcgtcaccgataaggaaaaacccgttaacatagaagccgagcctccttttggcgaatcgtacatagtggtaggggcaggagaaaaggctttaaagctgtcttggttcaaaaagggttcgagcatcggtaaa

SEQ ID NO: 630 - protein, 401 aa, Artificial Sequence
  STF2delta.DEN2EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQ

SEQ ID NO: 631 - DNA, 1203 bp, Artificial Sequence
  STF2delta.DEN2EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcatggataaactgcagctgaaaggtatgagctatagcatgtgtaccggtaaatttaaagttgttaaagaaattgcggaaacccagcatggtaccattgttattcgtgttcagtatgaaggtgatggtagcccgtgtaaaattccgtttgaaattatggatctggaaaaacgtcatgttctgggtcgtctgattaccgttaatccgattgttaccgaaaaagatagcccggttaatattgaagcggaaccgccgtttggtgatagctatattattattggtgttgaaccgggtcagctgaaactgaattggtttaaaaaaggtagcagcattggtcag

SEQ ID NO: 632 - protein, 401 aa, Artificial Sequence
  STF2delta.DEN3EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGK

SEQ ID NO: 633 - DNA, 1203 bp, Artificial Sequence
  STF2delta.DEN3EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcatggataaattagaattaaaaggaatgagttatgcaatgtgtttaaatacatttgtattaaaaaaagaagtaagtgaaacacaacatggaacaatattaataaaagtagaatataaaggagaagatgcaccatgtaaaataccatttagtacagaagatggacaaggaaaagcacataatggaagattaataacagcaaatccagtagtaacaaaaaaagaagaaccagtaaatatagaagcagaaccaccatttggagaaagtaatatagtaataggaataggagataaagcattaaaaataaattggtataagaaaggaagtagtataggaaaa

SEQ ID NO: 634 - protein, 401 aa, Artificial Sequence
  STF2delta.DEN4EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGK

SEQ ID NO: 635 - DNA, 1203 bp, Artificial Sequence
  STF2delta.DEN4EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcatggaaaagctgcgaataaagggaatgtcatacacgatgtgtagtggtaaattctctatagacaaagagatggcagagacacaacacgggacaaccgtcgtgaaggttaagtatgaaggagctggcgcaccgtgcaaagtacccatcgaaattagggatgtaaacaaagagaaggtcgttgggcgtatcattagctcaaccccacttgcggaaaatactaattctgtaacgaacatagagttggaaccaccttttggtgatagctatatagttattggtgtgggcaatagtgccttaactctacattggtttagaaaaggatcctcgatcgggaaa

SEQ ID NO: 636 - protein, 406 aa, Artificial Sequence
  DEN1 80%EHisBv
MRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIAQYENLKYSVIVTVHTGDQHQVGNETTEHGTTATITPQAPTSEIQLTDYGTLTLDCSPRTGLDFNEMVLLTMKKKSWLVHKQWFLDLPLPWTSGALTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKHHHHHH

SEQ ID NO: 637 - DNA, 1219 bp, Artificial Sequence
  DEN1 80%EHisBv
atgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagctcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaaaagaaatcatggcttgtccacaaacagtggtttctagacttaccactgccttggacctctggggctttaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaacatcaccatcaccatcac

SEQ ID NO: 638 - protein, 406 aa, Artificial Sequence
  DEN2 80%EHisBv
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSTTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQHHHHHH

SEQ ID NO: 639 - DNA, 1218 bp, Artificial Sequence
  DEN2 80%EHisBv
atgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccaccacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaacatcaccatcaccatcac

SEQ ID NO: 640 - protein, 404 aa, Artificial Sequence
  DEN3 80%EHisBv
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKHHHHHH

SEQ ID NO: 641 - DNA, 1212 bp, Artificial Sequence
  DEN3 80%EHisBv
atgcgttgcgtgggcgtgggtaatcgggattttgtagaaggcttatccggggcaacatgggtagacgtcgtactagagcacggtggatgtgttacgaccatggccaagaacaaaccaacgctcgatatagaactacagaagacagaagcaacccaattggcaactcttagaaagctctgtatagaaggaaaaatcacgaacatcactacagactcccgatgcccgacacaaggcgaagcgattttacctgaagagcaagatcagaattacgtgtgtaaacatacttacgtcgatcgtggctggggtaacggctgtgggcttttcgggaagggtagtttggtgacatgtgccaaatttcaatgcctcgaatctatagaaggcaaagttgtacagcacgaaaatcttaaatacactgttattatcactgtgcataccggggatcaacaccaagtcggaaatgagacacaaggggtgaccgcggagataaccccgcaagccagcactgtcgaagcaatattacccgagtatggcacgttaggcttggagtgctcaccaaggactggcctagactttaacgagatgattttgctgactatgaaaaacaaagcatggatggttcaccgccagtggttctttgatttacccttgccttggacgtcgggtgctacaactgaaaccccgacgtggaatcgaaaagaactgcttgtgacgtttaaaaacgctcatgcgaagaaacaggaggtcgtagttttgggttcacaagaaggagcgatgcacacggctttaacgggagccacagaaatccagaacagcggagggacatcgatcttcgctggacatctcaaatgtagactaaagatggacaaacttgaactcaagggtatgagttatgcaatgtgcctgaataccttcgtactgaagaaagaggtcagtgagacccagcatggtactatactaattaaagtagagtataagggtgaggatgctccttgcaagatacctttctctacagaagacgggcagggaaaagcgcataatgggaggctaattacggcgaacccagttgtaaccaaaaaggaggaaccagtcaacattgaggccgagccgccctttggagagtcaaatatagttatcggaattggtgacaaggctctgaagatcaattggtataagaaggggagctctattggtaagcaccaccatcatcaccac

SEQ ID NO: 642 - protein, 406 aa, Artificial Sequence
  DEN4 80%EHisBv
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVRIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCEVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKHHHHHH

SEQ ID NO: 643 - DNA, 1218 bp, Artificial Sequence
  DEN4 80%EHIsBv
atgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccgaattgagaaccttgaatacacagtggtggtaacagtccacaatggagacacccatgcagtaggaaatgacacatccaatcatggagttacagccatgataacccccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcgaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagcatcaccatcaccatcac

SEQ ID NO: 644 - protein, 112 aa, Artificial Sequence
  DEN1EIII+
MDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGK

SEQ ID NO: 645 - DNA, 336 bp, Artificial Sequence
  DEN1EIII+
atggacaaattgacgcttaagggaatgagttatgtaatgtgtactggatcatttaagttagagaaagaagttgcagagacgcagcatggcacggtcctagtacaagtgaaatatgagggtacagacgctccgtgcaaaattccattctccactcaggatgagaagggggcgacacaaaatgggagactcattaccgcgaatccaatcgtcaccgataaggaaaaacccgttaacatagaagccgagcctccttttggcgaatcgtacatagtggtaggggcaggagaaaaggctttaaagctgtcttggttcaaaaagggttcgagcatcggtaaa

SEQ ID NO: 646 - protein, 112 aa, Artificial Sequence
  DEN2EIII+
MDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQ

SEQ ID NO: 647 - DNA, 336 bp, Artificial Sequence
  DEN2EIII+
atggataaactgcagctgaaaggtatgagctatagcatgtgtaccggtaaatttaaagttgttaaagaaattgcggaaacccagcatggtaccattgttattcgtgttcagtatgaaggtgatggtagcccgtgtaaaattccgtttgaaattatggatctggaaaaacgtcatgttctgggtcgtctgattaccgttaatccgattgttaccgaaaaagatagcccggttaatattgaagcggaaccgccgtttggtgatagctatattattattggtgttgaaccgggtcagctgaaactgaattggtttaaaaaaggtagcagcattggtcag

SEQ ID NO: 648 - protein, 112 aa, Artificial Sequence
  DEN3EIII+
MDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGK

SEQ ID NO: 649 - DNA, 336 bp, Artificial Sequence
  DEN3EIII+
atggataaattagaattaaaaggaatgagttatgcaatgtgtttaaatacatttgtattaaaaaaagaagtaagtgaaacacaacatggaacaatattaataaaagtagaatataaaggagaagatgcaccatgtaaaataccatttagtacagaagatggacaaggaaaagcacataatggaagattaataacagcaaatccagtagtaacaaaaaaagaagaaccagtaaatatagaagcagaaccaccatttggagaaagtaatatagtaataggaataggagataaagcattaaaaataaattggtataagaaaggaagtagtataggaaaa

SEQ ID NO: 650 - protein, 112 aa, Artificial Sequence
  DEN4EIII+
MEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGK

SEQ ID NO: 651 - DNA, 336 bp, Artificial Sequence
  DEN4EIII+
atggaaaagctgcgaataaagggaatgtcatacacgatgtgtagtggtaaattctctatagacaaagagatggcagagacacaacacgggacaaccgtcgtgaaggttaagtatgaaggagctggcgcaccgtgcaaagtacccatcgaaattagggatgtaaacaaagagaaggtcgttgggcgtatcattagctcaaccccacttgcggaaaatactaattctgtaacgaacatagagttggaaccaccttttggtgatagctatatagttattggtgtgggcaatagtgccttaactctacattggtttagaaaaggatcctcgatcgggaaa

SEQ ID NO: 652 - protein, 495 aa, Artificial Sequence; identical to SEQ ID NO: 339
  DEN1 E protein

SEQ ID NO: 653 - DNA, 1485 bp, Artificial Sequence; identical to SEQ ID NO: 340
  DEN1 E protein

SEQ ID NO: 654 - protein, 495 aa, Artificial Sequence; identical to SEQ ID NO: 343
  DEN2 E protein

SEQ ID NO: 655 - DNA, 1485 bp, Artificial Sequence; identical to SEQ ID NO: 344
  DEN2 E protein

SEQ ID NO: 656 - protein, 493 aa, Artificial Sequence
  DEN3 E protein
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQA

SEQ ID NO: 657 - DNA, 1479 bp, Artificial Sequence; identical to SEQ ID NO: 346
  DEN3 E protein

SEQ ID NO: 658 - protein, 491 aa, Artificial Sequence; identical to SEQ ID NO: 347
  DEN4 E protein

SEQ ID NO: 659 - DNA, 1473 bp, Artificial Sequence; identical to SEQ ID NO: 348
  DEN4 E protein

SEQ ID NO: 660 - protein, 728 aa, Artificial Sequence
  STF2.HA1-2 (SI)
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 661 - protein, 505 aa, Artificial Sequence
  STF2
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 662 - protein, 272 aa, Artificial Sequence; identical to SEQ ID NO: 456
  HA1-1 (SI)

SEQ ID NO: 663 - protein, 512 aa, Artificial Sequence
  STF2.his6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRHHHHHH

SEQ ID NO: 664 - protein, 610 aa, Artificial Sequence
  STF.4xM2e
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRLSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 665 - protein, 565 aa, Artificial Sequence
  HA (SI)
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 666 - protein, 24 aa, Artificial Sequence
  M2e
SLLTEVETPIRNEWGSRSNDSSDP

SEQ ID NO: 667 - DNA, 2002 bp, Artificial Sequence
  STF2.HPV16 E6
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgcatcaaaaacgtactgctatgttccaagatccacaagagcgtccacgtaaactgccgcagctgtgcaccgaactgcagaccactatccacgatatcattctggaatgcgtgtattgcaaacaacagctgctgcgtcgtgaagtctacgattttgcctttcgcgacctgtgcatcgtttatcgcgacggtaacccgtatgctgtctgcgacaaatgcctgaaattttacagcaaaatctccgagtatcgtcattactgctattctctgtacggcacgactctggaacagcagtataacaaaccgctgtgcgacctgctgattcgttgcattaactgccagaagccgctgtgtccggaagaaaaacaacgtcacctggacaaaaagcagcgcttccacaacatccgtggtcgttggaccggccgttgcatgagctgctgccgctccagccgtacccgccgtgaaactcagctgtaatgagctgagc

SEQ ID NO: 668 - DNA, 1820 bp, Artificial Sequence
  STF2.HPV16 E7
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgcatggcgacaccccaactctgcatgaatacatgctggacctgcagccggaaacgaccgatctgtattgttacgaacagctgaacgattcctccgaagaagaagacgagatcgacggtccggcaggtcaagcggaaccagatcgtgcgcactataatatcgtgactttctgttgtaaatgtgactccaccctgcgtctgtgtgtgcagtctacccacgttgatatccgcaccctggaagatctgctgatgggcaccctgggtatcgtgtgcccgatctgcagccagaaaccgtaataagctga

SEQ ID NO: 669 - DNA, 2947 bp, Artificial Sequence
  STF2.HPV16 L2
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgcgtcataaacgttctgcaaagcgtactaagcgtgctagcgcaactcagctgtacaaaacgtgtaaacaggcgggtacgtgtccgcctgacatcatcccgaaagttgaaggcaaaactatcgcggaccagattctgcagtacggttctatgggtgttttttttggtggtctgggtatcggcaccggttctggcaccggtggccgcacgggttatattccgctgggtactcgtccgccgactgcgaccgataccctggcaccggtacgtccgccgctgaccgtcgacccggttggtccgtctgatccgtctattgtgtctctggtcgaagagactagcttcattgacgctggtgcgccgacttctgttccgagcatcccgcctgatgttagcggtttctccatcactacttccaccgacaccaccccagctattctggatatcaacaacaccgttaccaccgtgaccacccataacaacccgaccttcaccgacccgtctgtcctgcagccgcctaccccggctgaaaccggcggtcacttcactctgtcttcttccaccatctctacccacaactatgaagagatccctatggacacttttatcgtgtccaccaaccctaacaccgtcacctcttctaccccgattccgggctctcgtccagtggctcgcctgggtctgtactcccgcaccactcagcaggtgaaggttgtcgatccggcgtttgtgaccactccgactaaactgatcacttacgataatccggcttacgaaggtattgatgtagacaatactctgtacttctcttccaatgacaacagcattaacatcgcgccggacccggactttctggatatcgttgcactgcaccgcccagccctgacctcccgtcgtactggtatccgttacagccgtatcggcaacaagcagaccctgcgtacccgctctggtaaatccatcggcgccaaagtacactactattacgacttttccactatcgatccggcagaagagattgaactgcagaccatcactccgtccacttatactaccacctcccacgctgcatccccgactagcattaacaatggtctgtacgatatctatgccgatgatttcattaccgacacgtctaccaccccggttccgtctgtcccgtccacctctctgtccggctatatcccggcgaacactacgattccgttcggtggtgcatacaacattccgctggtgagcggcccggacattccgatcaacatcaccgatcaggctccatctctgatcccgatcgtaccgggttccccacagtacactattattgctgatgcgggtgatttctatctgcatccttcttactacatgctgcgtaaacgtcgtaaacgtctgccatacttcttctctgacgttagcctggctgcttaataagctgagc

SEQ ID NO: 670 - DNA, 1315 bp, Artificial Sequence
  STF2.HPV16 E7
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgcatcaaaaacgtactgctatgttccaagatccacaagagcgtccacgtaaactgccgcagctgtgcaccgaactgcagaccactatccacgatatcattctggaatgcgtgtattgcaaacaacagctgctgcgtcgtgaagtctacgattttgcctttcgcgacctgtgcatcgtttatcgcgacggtaacccgtatgctgtctgcgacaaatgcctgaaattttacagcaaaatctccgagtatcgtcattactgctattctctgtacggcacgactctggaacagcagtataacaaaccgctgtgcgacctgctgattcgttgcattaactgccagaagccgctgtgtccggaagaaaaacaacgtcacctggacaaaaagcagcgcttccacaacatccgtggtcgttggaccggccgttgcatgagctgctgccgctccagccgtacccgccgtgaaactcagctgtaatgagctgagc

SEQ ID NO: 671 - DNA, 1133 bp, Artificial Sequence
  STF2.HPV16 L2
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgcatggcgacaccccaactctgcatgaatacatgctggacctgcagccggaaacgaccgatctgtattgttacgaacagctgaacgattcctccgaagaagaagacgagatcgacggtccggcaggtcaagcggaaccagatcgtgcgcactataatatcgtgactttctgttgtaaatgtgactccaccctgcgtctgtgtgtgcagtctacccacgttgatatccgcaccctggaagatctgctgatgggcaccctgggtatcgtgtgcccgatctgcagccagaaaccgtaataagctga

SEQ ID NO: 672 - DNA, 2260 bp, Artificial Sequence
  STF2.HPV16 E6E7
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgcgtcataaacgttctgcaaagcgtactaagcgtgctagcgcaactcagctgtacaaaacgtgtaaacaggcgggtacgtgtccgcctgacatcatcccgaaagttgaaggcaaaactatcgcggaccagattctgcagtacggttctatgggtgttttttttggtggtctgggtatcggcaccggttctggcaccggtggccgcacgggttatattccgctgggtactcgtccgccgactgcgaccgataccctggcaccggtacgtccgccgctgaccgtcgacccggttggtccgtctgatccgtctattgtgtctctggtcgaagagactagcttcattgacgctggtgcgccgacttctgttccgagcatcccgcctgatgttagcggtttctccatcactacttccaccgacaccaccccagctattctggatatcaacaacaccgttaccaccgtgaccacccataacaacccgaccttcaccgacccgtctgtcctgcagccgcctaccccggctgaaaccggcggtcacttcactctgtcttcttccaccatctctacccacaactatgaagagatccctatggacacttttatcgtgtccaccaaccctaacaccgtcacctcttctaccccgattccgggctctcgtccagtggctcgcctgggtctgtactcccgcaccactcagcaggtgaaggttgtcgatccggcgtttgtgaccactccgactaaactgatcacttacgataatccggcttacgaaggtattgatgtagacaatactctgtacttctcttccaatgacaacagcattaacatcgcgccggacccggactttctggatatcgttgcactgcaccgcccagccctgacctcccgtcgtactggtatccgttacagccgtatcggcaacaagcagaccctgcgtacccgctctggtaaatccatcggcgccaaagtacactactattacgacttttccactatcgatccggcagaagagattgaactgcagaccatcactccgtccacttatactaccacctcccacgctgcatccccgactagcattaacaatggtctgtacgatatctatgccgatgatttcattaccgacacgtctaccaccccggttccgtctgtcccgtccacctctctgtccggctatatcccggcgaacactacgattccgttcggtggtgcatacaacattccgctggtgagcggcccggacattccgatcaacatcaccgatcaggctccatctctgatcccgatcgtaccgggttccccacagtacactattattgctgatgcgggtgatttctatctgcatccttcttactacatgctgcgtaaacgtcgtaaacgtctgccatacttcttctctgacgttagcctggctgcttaataagctgagc

SEQ ID NO: 673 - DNA, 2293 bp, Artificial Sequence
  STF2.HPV16 E6E7
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgcatcaaaaacgcactgcaatgttccaggatccgcaagaacgtccacgtaagctgccgcagctgtgcactgagctgcaaactactatccatgacatcatcctggagtgtgtgtattgcaaacaacagctgctgcgtcgtgaagtgtacgatttcgccttccgtgacctgtgcatcgtttatcgtgacggtaatccatacgccgtttgcgacaaatgcctgaaattttacagcaaaatctccgaataccgtcactattgctactctctgtacggcacgaccctggaacagcaatataacaaaccgctgtgcgacctgctgattcgttgtattaactgccagaagcctctgtgtccggaggaaaaacagcgtcacctggacaagaaacagcgctttcataacatccgcggtcgctggactggtcgttgtatgtcctgctgccgttcttcccgcactcgccgcgagactcagctgcatggtgatactcctactctgcatgagtacatgctggacctgcaaccggaaaccactgatctgtattgttacgaacagctgaacgatagctctgaagaagaggacgaaatcgacggtccagcaggtcaggctgaaccggaccgcgctcattataacatcgttacgttttgctgcaaatgcgacagcaccctgcgtctgtgtgttcagtctacccacgtagatattcgtactctggaggatctgctgatgggcactctgggcatcgtttgcccgatctgttcccagaaaccgtaataagctgagc

SEQ ID NO: 674 - DNA, 1606 bp, Artificial Sequence
  STF2delta.HPV16 E6E7
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgcatcaaaaacgcactgcaatgttccaggatccgcaagaacgtccacgtaagctgccgcagctgtgcactgagctgcaaactactatccatgacatcatcctggagtgtgtgtattgcaaacaacagctgctgcgtcgtgaagtgtacgatttcgccttccgtgacctgtgcatcgtttatcgtgacggtaatccatacgccgtttgcgacaaatgcctgaaattttacagcaaaatctccgaataccgtcactattgctactctctgtacggcacgaccctggaacagcaatataacaaaccgctgtgcgacctgctgattcgttgtattaactgccagaagcctctgtgtccggaggaaaaacagcgtcacctggacaagaaacagcgctttcataacatccgcggtcgctggactggtcgttgtatgtcctgctgccgttcttcccgcactcgccgcgagactcagctgcatggtgatactcctactctgcatgagtacatgctggacctgcaaccggaaaccactgatctgtattgttacgaacagctgaacgatagctctgaagaagaggacgaaatcgacggtccagcaggtcaggctgaaccggaccgcgctcattataacatcgttacgttttgctgcaaatgcgacagcaccctgcgtctgtgtgttcagtctacccacgtagatattcgtactctggaggatctgctgatgggcactctgggcatcgtttgcccgatctgttcccagaaaccgtaataagctgagc

SEQ ID NO: 675 - DNA, 1590 bp, Artificial Sequence
  STF2.HPV16 E6CTLHis6
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtactgagcctgttggcgatgctgcgtcgcgaggtttatgatttcgcatttcgtgatctgtgcattgtgcaccaccatcatcaccactaa

SEQ ID NO: 676 - DNA, 1736 bp, Artificial Sequence
  STF2.HPV16 4xE6CTLHis6
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtactgagcctgttggcgatgctgcgtcgcgaggtttatgatttcgcatttcgtgatctgtgcattgtgctgcgtcgcgaagtctacgatttcgcgtttcgtgacttgtgcatcgtcctgcgtcgtgaagtctatgactttgcgtttcgcgatctgtgtattgtcctgcgccgtgaagtgtacgacttcgccttccgtgacctgtgtatcgttcaccaccatcatcaccactaata

SEQ ID NO: 677 - DNA, 1602 bp, Artificial Sequence
  STF2.HPV16 E7CTLHis6
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtactgagcctgttggcgatgcaagccgagccggatcgtgctcactacaatatcgttacgttttgttgcaaatgtgaccaccatcatcaccaccactaataa

SEQ ID NO: 678 - DNA, 1773 bp, Artificial Sequence
  STF2.HPV16 4xE7CTLHis6
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtactgagcctgttggcgatgcaagccgagccggatcgtgctcactacaatatcgttacgttttgttgcaaatgtgaccaggcggaaccggaccgcgcacactataacattgttaccttctgctgcaagtgtgatcaggcggaaccggaccgtgcgcattacaatatcgtcaccttctgctgtaagtgcgatcaagcagagccagatcgtgcgcattacaacattgtgaccttttgctgtaaatgcgaccaccatcatcaccaccactaataa

SEQ ID NO: 679 - protein, 663 aa, Artificial Sequence
  STF2.HPV16 E6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 680 - protein, 10 aa, Artificial Sequence
  HPV16 E6 peptide
EVYDFAFRDL

SEQ ID NO: 681 - protein, 603 aa, Artificial Sequence; identical to SEQ ID NO: 200
  STF2.HPV16 E7

SEQ ID NO: 682 - protein, 978 aa, Artificial Sequence
  STF2.HPV16 L2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLARHKRSAKRTKRASATQLYKTCKQAGTCPPDIIPKVEGKTIADQILQYGSMGVFFGGLGIGTGSGTGGRTGYIPLGTRPPTATDTLAPVRPPLTVDPVGPSDPSIVSLVEETSFIDAGAPTSVPSIPPDVSGFSITTSTDTTPAILDINNTVTTVTTHNNPTFTDPSVLQPPTPAETGGHFTLSSSTISTHNYEEIPMDTFIVSTNPNTVTSSTPIPGSRPVARLGLYSRTTQQVKVVDPAFVTTPTKLITYDNPAYEGIDVDNTLYFSSNDNSINIAPDPDFLDIVALHRPALTSRRTGIRYSRIGNKQTLRTRSGKSIGAKVHYYYDFSTIDPAEEIELQTITPSTYTTTSHAASPTSINNGLYDIYADDFITDTSTTPVPSVPSTSLSGYIPANTTIPFGGAYNIPLVSGPDIPINITDQAPSLIPIVPGSPQYTIIADAGDFYLHPSYYMLRKRRKRLPYFFSDVSLAA

SEQ ID NO: 683 - protein, 434 aa, Artificial Sequence
  STF2delta.HPV16 E6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLAHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 684 - protein, 374 aa, Artificial Sequence
  STF2delta.HPV16 E7
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLAHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 685 - protein, 749 aa, Artificial Sequence
  STF2delta.HPV16 L2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLARHKRSAKRTKRASATQLYKTCKQAGTCPPDIIPKVEGKTIADQILQYGSMGVFFGGLGIGTGSGTGGRTGYIPLGTRPPTATDTLAPVRPPLTVDPVGPSDPSIVSLVEETSFIDAGAPTSVPSIPPDVSGFSITTSTDTTPAILDINNTVTTVTTHNNPTFTDPSVLQPPTPAETGGHFTLSSSTISTHNYEEIPMDTFIVSTNPNTVTSSTPIPGSRPVARLGLYSRTTQQVKVVDPAFVTTPTKLITYDNPAYEGIDVDNTLYFSSNDNSINIAPDPDFLDIVALHRPALTSRRTGIRYSRIGNKQTLRTRSGKSIGAKVHYYYDFSTIDPAEEIELQTITPSTYTTTSHAASPTSINNGLYDIYADDFITDTSTTPVPSVPSTSLSGYIPANTTIPFGGAYNIPLVSGPDIPINITDQAPSLIPIVPGSPQYTIIADAGDFYLHPSYYMLRKRRKRLPYFFSDVSLAA

SEQ ID NO: 686 - protein, 760 aa, Artificial Sequence
  STF2.HPV16 E6E7
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQLHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 687 - protein, 531 aa, Artificial Sequence
  STF2delta.HPV16 E6E7
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLAHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQLHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 688 - protein, 529 aa, Artificial Sequence
  STF2.HPV16 E6CTLHis6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAMLRREVYDFAFRDLCIVHHHHHH

SEQ ID NO: 689 - protein, 577 aa, Artificial Sequence
  STF2.HPV16 4xE6CTL His6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAMLRREVYDFAFRDLCIVLRREVYDFAFRDLCIVLRREVYDFAFRDLCIVLRREVYDFAFRDLCIVHHHHHH

SEQ ID NO: 690 - protein, 532 aa, Artificial Sequence
  STF2.HPV16 E7CTLHis6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAMQAEPDRAHYNIVTFCCKCDHHHHHH

SEQ ID NO: 691 - protein, 589 aa, Artificial Sequence
  STF2.HPV16 4xE7CTLHis6
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAMQAEPDRAHYNIVTFCCKCDQAEPDRAHYNIVTFCCKCDQAEPDRAHYNIVTFCCKCDQAEPDRAHYNIVTFCCKCDHHHHHH

SEQ ID NO: 692 - DNA, 2293 bp, Artificial Sequence; identical to SEQ ID NO: 673
  STF2

SEQ ID NO: 693 - protein, 10 aa, Artificial Sequence
  flagellin C-terminal peptide
VPQNVLSLLA

SEQ ID NO: 694 - protein, 57 aa, Artificial Sequence
  RSVF peptide
PVSVLTSKVLDLKNYIDKQLLPIVNKQSCSISNIETVIEFQQKNNRLLEITREFSVN

SEQ ID NO: 695 - protein, 756 aa, Artificial Sequence
  STF2.RSVF(DIII)
PMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLA

SEQ ID NO: 696 - protein, 756 aa, Artificial Sequence
  STF2.RSVF(DIII)mut
PMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRTGWYTSVITIELSNIKETKCNGTDTKVKLIKQELDKYKNAVTELQLLMQNTPAANNRASSEAPQYMNYTINTTKNLNVSISKKRKSSFLGFLLGVGSAIASGILVSKLLHLEGEVNKIKNALLSTNKAVVSLSNGVSVLTSKVLCLKNYINNQLLPIVNQQSCRISNIETVIEFQQKNSRLLEINREFSVLAGVTTPLSTYMLTNCELLSLINDMPITNDQKKLMSSNVQILRQQSYSIMSIIKEEVLA

SEQ ID NO: 697 - protein, 756 aa, Artificial Sequence
  RSVF(DIII).STF2
PTGWYTSVITIELSNIKENKCNGTDAKVKLIKQELDKYKNAVTELQLLMQSTPATNNRASSELPRFMNYTLNNAKKTNVTLSKKRKSSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 698 - protein, 756 aa, Artificial Sequence
  RSVF(DIII)mut.STF2
PTGWYTSVITIELSNIKETKCNGTDTKVKLIKQELDKYKNAVTELQLLMQNTPAANNRASSEAPQYMNYTINTTKNLNVSISKKRKSSFLGFLLGVGSAIASGILVSKLLHLEGEVNKIKNALLSTNKAVVSLSNGVSVLTSKVLCLKNYINNQLLPIVNQQSCRISNIETVIEFQQKNSRLLEINREFSVLAGVTTPLSTYMLTNCELLSLINDMPITNDQKKLMSSNVQILRQQSYSIMSIIKEEVLAMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 699 - protein, 401 aa, Artificial Sequence
  fliC R3
PMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGNADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLR

SEQ ID NO: 700 - protein, 443 aa, Artificial Sequence
  E. coli R3
PMAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDSVTMGGTTYNFKTGADAGAATANAGVSFTDTASKETVLNKVATAKQGTAVAANGDTSATITYKSGVQTYQAVFAAGDGTASAKYADNTDVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQVPQQVLSLLQG

SEQ ID NO: 701 - protein, 304 aa, Artificial Sequence
  Bacillus subtilis R3
PMRINHNIAALNTSRQLNAGSDSAAKNMEKLSSGLRINRAGDDAAGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGTTYTVSGWADADDATNKPAGYYDAGGKVIASEKLAADSKVTKGIDISSSAKAASSALTTIKTAIDTVSSERAKLGAVQNRLEHTINNLGTSSENLTSAESRIRDVDMASEMMEYTKNNILTQASQAMLAQANQ

SEQ ID NO: 702 - DNA, 2406 bp, Artificial Sequence
  STF2.HA1-1 B/Mal
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaccactaccccaaccaaatctcacttcgcaaacctgaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttccctgccgctgatcggtgaagcagactgcctgcacgagaaatacggcggtctgaacaaaagcaagccgtactataccggcgaacatgcgaaagcaattggtaactgtccaatttgggtgaaatagtag

SEQ ID NO: 703 - protein, 800 aa, Artificial Sequence
  STF2.HA1-1 B/Mal
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLATTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 704 - DNA, 2247 bp, Artificial Sequence
  STF2.HA1-2 B/Mal
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 705 - protein, 747 aa, Artificial Sequence
  STF2.HA1-2 B/Mal
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 706 - DNA, 2244 bp, Artificial Sequence
  STF2.HA1-2 B/SH
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactcgtacccgcggtaagctgtgcccggactgcctgaactgtaccgatctggatgttgcactgggtcgtccgatgtgcgttggtaccaccccgtctgcgaaagccagcatcctgcacgaagttcgcccggttacttccggttgtttcccgattatgcatgatcgtaccaaaattcgtcagctgccaaacctgctgcgtggctatgaaaacattcgtctgtccactcaaaacgtaatcgatgcagaaaaagcgctgggtggcccgtatcgtctgggtaccagcggctcctgcccgaacgcgacgagcaaaagcggcttcttcgccaccatggcttgggccgttccgaaagacaacaacaaaaacgctacgaacccgctgaccgtcgaagtcccgtacatctgcaccgaaggcgaagatcagatcactgtgtggggcttccacagcgatgataagacccagatgaaaaatctgtacggtgactccaacccgcagaaattcacctcttctgctaacggtgtaacgacccactacgtttctcagatcggtggtttcccggaccagacggaagatggcggtctgcctcagtccggccgcatcgtagttgattacatggtccagaaaccgggtaagactggtaccattgtttaccagcgtggtgtactgctgccgcagaaggtctggtgtgcttccggccgttccaaggtcattaagggctgatag

SEQ ID NO: 707 - protein, 746 aa, Artificial Sequence
  STF2.HA1-2 B/SH
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKG

SEQ ID NO: 708 - DNA, 2247 bp, Artificial Sequence
  STF2.HA1-2 B/OH
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactaaaacccgtggcaagctgtgtccgaagtgtctgaactgcaccgatctggacgtcgcactgggtcgtccgaaatgtactggtaacattccgtccgcggaagtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaaggcgccgggcggtccctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacgatttggggcttccactccgacagcgagacacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 709 - protein, 747 aa, Artificial Sequence
  STF2.HA1-2 B/OH
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 710 - DNA, 2244 bp, Artificial Sequence
  STF2.HA1-2 B/LEE
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactcagacccgtggcaagctgtgtccgaactgtttcaactgcaccgatctggacgttgcactgggtcgtccgaaatgcatgggtaacatcccgtctgcgaaggtaagcatcctgcacgaagttaaaccggtaaccagcggctgtttcccgatcatgcacgacaaaactaaaattcgtcagctgccgaacctgctgcgtggttatgagaacattcgtctgtctacctctaatgttatcaacgcggagactgcaccaggtggcccatacaaagtaggtaccagcggttcctgtccgaacgttgcgaatcgtaacggcttcttcaacactatggcgtgggttatcccgaaagataacaataaaactgcaattaacccggtaactgtagaagttccgtacatctgctccgaaggcgaggaccagattacggtatggggctttcacagcgacgataaaacccagatggagcgtctgtacggtgactctaacccgcagaaattcacctcctccgcgaacggcgttaccacccactatgtttctcagatcggcggtttcccgaatcagaccgaagacgaaggcctgaagcagtccggccgtattgttgtagactacatggttcagaagccgggcaaaactggtaccattgtataccagcgcggcatcctgctgccgcagaaagtttggtgcgcttccggtcgtagcaaagtaatcaaaggttgatag

SEQ ID NO: 711 - protein, 746 aa, Artificial Sequence
  STF2.HA1-2 B/LEE
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGTQTRGKLCPNCFNCTDLDVALGRPKCMGNIPSAKVSILHEVKPVTSGCFPIMHDKTKIRQLPNLLRGYENIRLSTSNVINAETAPGGPYKVGTSGSCPNVANRNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKG

SEQ ID NO: 712 - DNA, 1692 bp, Artificial Sequence
  STF2D2D3.HA1-1 B/MAL
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaccactaccccaaccaaatctcacttcgcaaacctgaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttccctgccgctgatcggtgaagcagactgcctgcacgagaaatacggcggtctgaacaaaagcaagccgtactataccggcgaacatgcgaaagcaattggtaactgtccaatttgggtgaaatagtag

SEQ ID NO: 713 - protein, 562 aa, Artificial Sequence
  STF2D2D3.HA1-1 B/MAL
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEARSRIEDSDYATEVSNMSRAQILQQAGTSVLAQANQVPQNVLSLLATTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 714 - DNA, 1533 bp, Artificial Sequence
  STF2D2D3.HA1-2 B/MAL
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 715 - protein, 509 aa, Artificial Sequence
  STF2D2D3.HA1-2 B/MAL
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEARSRIEDSDYATEVSNMSRAQILQQAGTSVLAQANQVPQNVLSLLAKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 716 - DNA, 1530 bp, Artificial Sequence
  STF2D2D3.HA1-2 B/SH
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactcgtacccgcggtaagctgtgcccggactgcctgaactgtaccgatctggatgttgcactgggtcgtccgatgtgcgttggtaccaccccgtctgcgaaagccagcatcctgcacgaagttcgcccggttacttccggttgtttcccgattatgcatgatcgtaccaaaattcgtcagctgccaaacctgctgcgtggctatgaaaacattcgtctgtccactcaaaacgtaatcgatgcagaaaaagcgctgggtggcccgtatcgtctgggtaccagcggctcctgcccgaacgcgacgagcaaaagcggcttcttcgccaccatggcttgggccgttccgaaagacaacaacaaaaacgctacgaacccgctgaccgtcgaagtcccgtacatctgcaccgaaggcgaagatcagatcactgtgtggggcttccacagcgatgataagacccagatgaaaaatctgtacggtgactccaacccgcagaaattcacctcttctgctaacggtgtaacgacccactacgtttctcagatcggtggtttcccggaccagacggaagatggcggtctgcctcagtccggccgcatcgtagttgattacatggtccagaaaccgggtaagactggtaccattgtttaccagcgtggtgtactgctgccgcagaaggtctggtgtgcttccggccgttccaaggtcattaagggctgatag

SEQ ID NO: 717 - protein, 508 aa, Artificial Sequence
  STF2D2D3.HA1-2 B/SH
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEARSRIEDSDYATEVSNMSRAQILQQAGTSVLAQANQVPQNVLSLLAKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKG

SEQ ID NO: 718 - DNA, 1533 bp, Artificial Sequence
  STF2D2D3.HA1-2 B/OH
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactaaaacccgtggcaagctgtgtccgaagtgtctgaactgcaccgatctggacgtcgcactgggtcgtccgaaatgtactggtaacattccgtccgcggaagtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaaggcgccgggcggtccctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacgatttggggcttccactccgacagcgagacacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 719 - protein, 509 aa, Artificial Sequence
  STF2D2D3.HA1-2 B/OH
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEARSRIEDSDYATEVSNMSRAQILQQAGTSVLAQANQVPQNVLSLLAKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 720 - DNA, 1530 bp, Artificial Sequence
  STF2D2D3.HA1-2 B/LEE
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactcagacccgtggcaagctgtgtccgaactgtttcaactgcaccgatctggacgttgcactgggtcgtccgaaatgcatgggtaacatcccgtctgcgaaggtaagcatcctgcacgaagttaaaccggtaaccagcggctgtttcccgatcatgcacgacaaaactaaaattcgtcagctgccgaacctgctgcgtggttatgagaacattcgtctgtctacctctaatgttatcaacgcggagactgcaccaggtggcccatacaaagtaggtaccagcggttcctgtccgaacgttgcgaatcgtaacggcttcttcaacactatggcgtgggttatcccgaaagataacaataaaactgcaattaacccggtaactgtagaagttccgtacatctgctccgaaggcgaggaccagattacggtatggggctttcacagcgacgataaaacccagatggagcgtctgtacggtgactctaacccgcagaaattcacctcctccgcgaacggcgttaccacccactatgtttctcagatcggcggtttcccgaatcagaccgaagacgaaggcctgaagcagtccggccgtattgttgtagactacatggttcagaagccgggcaaaactggtaccattgtataccagcgcggcatcctgctgccgcagaaagtttggtgcgcttccggtcgtagcaaagtaatcaaaggttgatag

SEQ ID NO: 721 - protein, 508 aa, Artificial Sequence
  STF2D2D3.HA1-2 B/LEE
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEARSRIEDSDYATEVSNMSRAQILQQAGTSVLAQANQVPQNVLSLLAKGTQTRGKLCPNCFNCTDLDVALGRPKCMGNIPSAKVSILHEVKPVTSGCFPIMHDKTKIRQLPNLLRGYENIRLSTSNVINAETAPGGPYKVGTSGSCPNVANRNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKG

SEQ ID NO: 722 - DNA, 1272 bp, Artificial Sequence
  STF2D0D2D3.HA1-2 B/MAL
atgggccaagctattgctaaccgtttcaccgctaacattaaaggtctgactcaagcttctcgtaacgcaaacgatggcatcagcatcgcgcagaccaccgaaggtgcactgaacgaaatcaacaacaatctgcagcgtgtacgtgaactggctgtgcagtccgctaattccaccaactcccagtctgatctggattccatccaagcggaaattactcagcgtctgaatgaaatcgaccgcgtatccggccagactcagttcaacggtgtgaaggttctggcgcaggataacactctgactatccaggttggcgctaatgatggcgagacgatcgatattgacctgaagcagattaattcccagacgctgggcctggattccctgaacgtccagactaccgaaaacccgctgcagaaaatcgacgcagcactggctcaggttgatgcactgcgctctgacctgggcgcggttcagaaccgctttaactctgctatcaccaacctgggcaacaccgttaacaatctgagcgaagctaaaggatccaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 723 - protein, 422 aa, Artificial Sequence
  STF2D0D2D3.HA1-2 B/MAL
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEAKGSKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 724 - DNA, 2193 bp, Artificial Sequence
  STF2.HA1-2 Anhui
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcaagcgttaaaccgctgattctgcgcgactgctctgtcgcgggttggctgctgggtaacccgatgtgcgacgagttcattaatgttccggaatggtcttacattgtcgaaaaagcgaacccggctaacgacctgtgttacccaggcaacttcaacgattatgaagaactgaaacacctgctgtcccgtattaaccatttcgaaaagatccaaatcattccaaagtcctcctggtccgatcatgaagcatcctccggtgtgtcttccgcatgtccatatcagggtactccgtctttcttccgtaacgtggtttggctgatcaaaaagaacaacacctacccgacgatcaagcgctcctacaacaacaccaaccaggaagatctgctgatcctgtggggtattcaccattctaacgacgcagcagagcagaccaaactgtaccagaacccaaccacgtacatcagcgtgggtaccagcaccctgaaccagcgtctggtgccgaaaatcgctacccgttccaaagtgaacggccagtccggtcgtatggacttcttttggaccattctgaaaccgaacgatgctatcaactttgaatccaacggcaatttcatcgcacctgagtatgcgtataaaatcgttaaaaagggcgattccgctatcgtgaagagcgagtgatag

SEQ ID NO: 725 - protein, 729 aa, Artificial Sequence
  STF2.HA1-2 Anhui
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSE

SEQ ID NO: 726 - DNA, 1563 bp, Artificial Sequence
  nucleic acid sequence for STF2.13E
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcggaggaagaggaagaggaagaagaggaagaggaagaggaatgatag

SEQ ID NO: 727 - protein, 519 aa, Artificial Sequence
  STF2.13E
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAEEEEEEEEEEEEE

SEQ ID NO: 728 - DNA, 2241 bp, Artificial Sequence
  STF2(2CS).HA1-2 B/MAL
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtaggcttgttcggcgctattgctggtttcattgaaggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcgggcttgttcggcgctattgctggtttcattgaaacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 729 - protein, 745 aa, Artificial Sequence
  STF2(2CS).HA1-2 B/MAL
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVGLFGAIAGFIEGGTNGTASVTGGAVKFDADNNKYFVTIGGFTGADAAKNGDYEVNVATDGTVTLAGLFGAIAGFIETTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 730 - DNA, 1833 bp, Artificial Sequence
  STF2(2CS).4M2e(HU)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacgctggatgtaggcttgttcggcgctattgctggtttcattgaaggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcgggcttgttcggcgctattgctggtttcattgaaacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtctgagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataataa

SEQ ID NO: 731 - protein, 609 aa, Artificial Sequence
  STF2(2CS).4M2e (HU) (Fusion of 4xM2e to the C terminus and fusion of 2 H1/H5 CS into D3
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVGLFGAIAGFIEGGTNGTASVTGGAVKFDADNNKYFVTIGGFTGADAAKNGDYEVNVATDGTVTLAGLFGAIAGFIETTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRLSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 732 - DNA, 1838 bp, Artificial Sequence
  STF2(2CS+R).4M2e(HU)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacgctggatgtacgcggcttgttcggcgctattgctggtttcattgaaggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcgcgcggcttgttcggcgctattgctggtttcattgaaacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtctgagcttgctgactgaggttggaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataataa

SEQ ID NO: 733 - protein, 611 aa, Artificial Sequence
  STF2(2CS+R).4M2e(HU) (fusion of 4xM2e to the C terminus and fusion of 2 H1/H5 CS into D3; conserved R residue added to the N-terminus of CS)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVRGLFGAIAGFIEGGTNGTASVTGGAVKFDADNNKYFVTIGGFTGADAAKNGDYEVNVATDGTVTLARGLFGAIAGFIETTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRLSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 734 - DNA, 1911 bp, Artificial Sequence
  STF24CS.4M2e(HU) (2xCS in Region 1 and 2xCS in Reg3)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacgctggatgtacgcggcttgttcggcgctattgctggtttcattgaacgtggcctcttcggtgcgatcgccgggttcatcgagggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcgcgtggtctgtttggggcgatcgcgggctttatcgagcgcggcctcttcggtgccattgccgggttcattgagacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtctgagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataataa

SEQ ID NO: 735 - protein, 634 aa, Artificial Sequence
  STF24CS.4M2e(HU) (2xCS in Region 1 and 2xCS in Reg3) (fusion of 4xM2e to the C terminus and fusion of 4 H1/H5 CS into portions of D3)
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVRGLFGAIAGFIERGLFGAIAGFIEGGTNGTASVTGGAVKFDADNNKYFVTIGGFTGADAAKNGDYEVNVATDGTVTLARGLFGAIAGFIERGLFGAIAGFIETTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRLSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 736 - DNA, 1869 bp, Artificial Sequence
  STF2(4CS:Reg1234).4M2e(HU)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacgctggatgtacgcggcttgttcggcgctattgctggtttcattgaaggtggtacgaatggtacggcttctgtaaccggtggtgcggttaaatttgacgcagataataacaagtactttgttactattggtggctttactcgcggcttgttcggcgctattgctggtttcattgaaaaaaatggcgattatgaagttaacgttgctactgacggtacagtaacccttgcgcgcggcttgttcggcgctattgctggtttcattgaaacaactaaaacagaagtacaggagttaaaagatacaccggcagttgtttcagcagatgctaaaaatgccttaattgctggcggccgcggcttgttcggcgctattgctggtttcattgaagagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtctgagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataataa

SEQ ID NO: 737 - protein, 621 aa, Artificial Sequence
  STF2(4CS:Reg1234).4M2e (HU) (fusion of 4xM2e to the C terminus and fusion of 4 H1/H5 CS into portions of D3).
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVRGLFGAIAGFIEGGTNGTASVTGGAVKFDADNNKYFVTIGGFTRGLFGAIAGFIEKNGDYEVNVATDGTVTLARGLFGAIAGFIETTKTEVQELKDTPAVVSADAKNALIAGGRGLFGAIAGFIEELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRLSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 738 - DNA, 2037 bp, Artificial Sequence
  nucleic acid of STF2D3.HA1-1 SI
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgtctcataacggtaaactgtgcctgctgaaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactctaacgcgccgatggatgaatgcgatgcgaaatgccagaccccgcagggcgcgattaacagctctctgccgttccagaacgttcacccggttaccatcggtgaatgcccgaaatacgttcgttaataa

SEQ ID NO: 739 - protein, 677 aa, Artificial Sequence
  STF2D3.HA1-1 SI
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVR

SEQ ID NO: 740 - DNA, 1902 bp, Artificial Sequence
  STF2D3N.HA1-1 SI
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgtctcataacggtaaactgtgcctgctgaaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactctaacgcgccgatggatgaatgcgatgcgaaatgccagaccccgcagggcgcgattaacagctctctgccgttccagaacgttcacccggttaccatcggtgaatgcccgaaatacgttcgttaataa

SEQ ID NO: 741 - protein, 632 aa, Artificial Sequence
  STF2D3N.HA1-1 SI
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVR

SEQ ID NO: 742 - DNA, 1872 bp, Artificial Sequence
  nucleic acid seqence for STF2D3NCs.HA1-1 SI
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccagtctcataacggtaaactgtgcctgctgaaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactctaacgcgccgatggatgaatgcgatgcgaaatgccagaccccgcagggcgcgattaacagctctctgccgttccagaacgttcacccggttaccatcggtgaatgcccgaaatacgttcgttaataa

SEQ ID NO: 743 - protein, 622 aa, Artificial Sequence
  STF2D3NCs.HA1-1 SI
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVR

SEQ ID NO: 744 - DNA, 2050 bp, Artificial Sequence
  nucleic acid sequence STF2D3.HA1-1 VN
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcggagaagaaacacaatggcaaactgtgtgatctggatggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagctggaatatggcaactgtaacaccaaatgccagaccccgatgggtgcaatcaactcctccatgccgtttcacaacattcacccgctgactatcggcgaatgtccgaaatacgttaaatagtaagctgagc

SEQ ID NO: 745 - protein, 679 aa, Artificial Sequence
  STF2D3.HA1-1 VN
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVK

SEQ ID NO: 746 - DNA, 1915 bp, Artificial Sequence
  nucleic acid sequence for STF2D3N.HA1-1 VN
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcggagaagaaacacaatggcaaactgtgtgatctggatggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagctggaatatggcaactgtaacaccaaatgccagaccccgatgggtgcaatcaactcctccatgccgtttcacaacattcacccgctgactatcggcgaatgtccgaaatacgttaaatagtaagctgagc

SEQ ID NO: 747 - protein, 634 aa, Artificial Sequence
  STF2D3N.HA1-1 VN
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVK

SEQ ID NO: 748 - DNA, 1885 bp, Artificial Sequence
  STF2D3NCs.HA1-1 VN
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggagaagaaacacaatggcaaactgtgtgatctggatggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagctggaatatggcaactgtaacaccaaatgccagaccccgatgggtgcaatcaactcctccatgccgtttcacaacattcacccgctgactatcggcgaatgtccgaaatacgttaaatagtaagctgagc

SEQ ID NO: 749 - protein, 624 aa, Artificial Sequence
  STF2D3NCs.HA1-1 VN
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVK

SEQ ID NO: 750 - DNA, 1365 bp, Artificial Sequence
  STF2D0D2D3.HA1-1 VN
atgggccaagctattgctaaccgtttcaccgctaacattaaaggtctgactcaagcttctcgtaacgcaaacgatggcatcagcatcgcgcagaccaccgaaggtgcactgaacgaaatcaacaacaatctgcagcgtgtacgtgaactggctgtgcagtccgctaattccaccaactcccagtctgatctggattccatccaagcggaaattactcagcgtctgaatgaaatcgaccgcgtatccggccagactcagttcaacggtgtgaaggttctggcgcaggataacactctgactatccaggttggcgctaatgatggcgagacgatcgatattgacctgaagcagattaattcccagacgctgggcctggattccctgaacgtccagactaccgaaaacccgctgcagaaaatcgacgcagcactggctcaggttgatgcactgcgctctgacctgggcgcggttcagaaccgctttaactctgctatcaccaacctgggcaacaccgttaacaatctgagcgaagctaaagagaagaaacacaatggcaaactgtgtgatctggatggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagctggaatatggcaactgtaacaccaaatgccagaccccgatgggtgcaatcaactcctccatgccgtttcacaacattcacccgctgactatcggcgaatgtccgaaatacgttaaatagtaa

SEQ ID NO: 751 - protein, 453 aa, Artificial Sequence
  STF2D0D2D3.HA1-1 VN
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEAKEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVK

SEQ ID NO: 752 - DNA, 1890 bp, Artificial Sequence
  STF2D3.HA1-2 SI
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactcttaataa

SEQ ID NO: 753 - protein, 628 aa, Artificial Sequence
  STF2D3.HA1-2 SI
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 754 - DNA, 1755 bp, Artificial Sequence
  STF2D3N.HA1-2 SI
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgaaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactcttaataa

SEQ ID NO: 755 - protein, 583 aa, Artificial Sequence
  STF2D3N.HA1-2 SI
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 756 - DNA, 1725 bp, Artificial Sequence
  STF2D3NCs.HA1-2 SI
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccagaaaggtatcgcaccactgcagctgggtaactgttctgtagcaggttggatcctgggtaacccggaatgtgagctgctgatttctcgtgaaagctggtcttacatcgtcgagaaaccgaacccggaaaatggtacttgctacccgggtcatttcgcagattacgaagaactgcgcgaacagctgtcttctgtttcttccttcgagcgtttcgaaatcttcccgaaagaatcctcttggccgaaccacactactaccggcgtgtctgcgtcctgcagccacaacggcgaaagctccttctacaaaaacctgctgtggctgaccggcaagaacggtctgtatccgaacctgagcaaaagctatgctaacaacaaagagaaagaagtgctggtactgtggggtgttcaccaccctccgaacattggcgatcagcgcgctctgtaccacaaagaaaacgcatacgtaagcgttgtgtcttctcactacagccgtaaattcacgccggaaatcgctaaacgccctaaagtgcgtgaccaggaaggtcgcatcaactactattggaccctgctggaacctggtgacaccattatcttcgaagcaaacggtaatctgatcgcacctcgttatgctttcgccctgtctcgtggttttggttccggcattatcaactcttaataa

SEQ ID NO: 757 - protein, 573 aa, Artificial Sequence
  STF2D3NCs.HA1-2 SI
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 758 - DNA, 1897 bp, Artificial Sequence
  STF2D3.HA1-2 VN
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtagtaagctgagc

SEQ ID NO: 759 - protein, 628 aa, Artificial Sequence
  STF2D3.HA1-2 VN
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 760 - DNA, 1762 bp, Artificial Sequence
  STF2D3N.HA1-2 VN
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtagtaagctgagc

SEQ ID NO: 761 - protein, 583 aa, Artificial Sequence
  STF2D3N.HA1-2 VN
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 762 - DNA, 1732 bp, Artificial Sequence
  STF2D3NCs.HA1-2 VN
atgggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagctgcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccagggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtagtaagctgagc

SEQ ID NO: 763 - protein, 573 aa, Artificial Sequence
  STF2D3NCs.HA1-2 VN
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 764 - protein, 53 aa, Artificial Sequence
  HPV 6 E7 CR3 domain
PPLKQHYQIVTCCCGCDSNVRLVVQCTETDIREVQQLLLGTLNIVCPICAPKT

SEQ ID NO: 765 - protein, 53 aa, Artificial Sequence
  HPV 11 E7 CR3 domain
PPLTQHYQILTCCCGCDSNVRLVVECTDGDIRQLQDLLLGTLNIVCPICAPKP

SEQ ID NO: 766 - protein, 53 aa, Artificial Sequence
  HPV 16 E7 CR3 domain
PPDRAHYNIVTFCCKCDSTLRLCVQSTHVDIRTLEDLLMGTLGIVCPICSQKP

SEQ ID NO: 767 - protein, 57 aa, Artificial Sequence
  HPV 18 E7 CR3 domain
PPARRAEPQRHTMLCMCCKCEARIELVVESSADDLRAFQQLFLNTLSFVCPWCASQQ

SEQ ID NO: 768 - protein, 55 aa, Artificial Sequence
  HPV 31 E7 CR3 domain
PAEPDTSNYNIVTFCCQCKSTLRLCVQSTQVDIRILQELLMGSFGIVCPNCSTRL

SEQ ID NO: 769 - protein, 53 aa, Artificial Sequence
  HPV 45 E7 CR3 domain
PAEPQRHKILCVCCKCDGRIELTVESSAEDLRTLQQLFLSTLSFVCPWCATNQ

SEQ ID NO: 770 - protein, 247 aa, Artificial Sequence
  R3 construct
GALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAAL

SEQ ID NO: 771 - protein, 285 aa, Artificial Sequence
  R3 construct
LTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNS

SEQ ID NO: 772 - protein, 335 aa, Artificial Sequence
  R3 construct
LRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYA

SEQ ID NO: 773 - protein, 405 aa, Artificial Sequence; identical to SEQ ID NO: 29
  R3 construct

SEQ ID NO: 774 - protein, 385 aa, Artificial Sequence
  R3 construct
SLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQ

SEQ ID NO: 775 - protein, 401 aa, Artificial Sequence
  R3 construct
QVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSL

SEQ ID NO: 776 - protein, 198 aa, Artificial Sequence
  R3D0 construct
QSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKA

SEQ ID NO: 777 - protein, 228 aa, Artificial Sequence
  R3D0 construct
RVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENP

SEQ ID NO: 778 - protein, 258 aa, Artificial Sequence
  R3D0 construct
QTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALR

SEQ ID NO: 779 - protein, 286 aa, Artificial Sequence
  R3D0 construct
LTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSA

SEQ ID NO: 780 - protein, 305 aa, Artificial Sequence
  R3D0 construct
RFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNL

SEQ ID NO: 781 - protein, 316 aa, Artificial Sequence
  R3D0 construct
GQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARS

SEQ ID NO: 782 - protein, 218 aa, Artificial Sequence
  D3N construct
TQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRS

SEQ ID NO: 783 - protein, 260 aa, Artificial Sequence
  D3N construct
AVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVN

SEQ ID NO: 784 - protein, 290 aa, Artificial Sequence
  D3N construct
ALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYA

SEQ ID NO: 785 - protein, 325 aa, Artificial Sequence
  D3N construct
ASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTS

SEQ ID NO: 786 - protein, 343 aa, Artificial Sequence
  D3N construct
FTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQV

SEQ ID NO: 787 - protein, 358 aa, Artificial Sequence
  D3N construct
GQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLL

SEQ ID NO: 788 - protein, 213 aa, Artificial Sequence
  D3NCs construct
ITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQ

SEQ ID NO: 789 - protein, 252 aa, Artificial Sequence
  D3NCs construct
VQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAIT

SEQ ID NO: 790 - protein, 283 aa, Artificial Sequence
  D3NCs construct
ALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSR

SEQ ID NO: 791 - protein, 318 aa, Artificial Sequence
  D3NCs construct
TQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRA

SEQ ID NO: 792 - protein, 336 aa, Artificial Sequence
  D3NCs construct
FTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSV

SEQ ID NO: 793 - protein, 348 aa, Artificial Sequence
  D3NCs construct
GQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQAN

SEQ ID NO: 794 - protein, 112 aa, Artificial Sequence
  D1 construct
LNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVD

SEQ ID NO: 795 - protein, 127 aa, Artificial Sequence
  D1 construct
SIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDL

SEQ ID NO: 796 - protein, 146 aa, Artificial Sequence
  D1 construct
ASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSA

SEQ ID NO: 797 - protein, 165 aa, Artificial Sequence
  D1 construct
FTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVN

SEQ ID NO: 798 - protein, 174 aa, Artificial Sequence
  D1 construct
IANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEA

SEQ ID NO: 799 - protein, 180 aa, Artificial Sequence
  D1 construct
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQTTENPLQKIDAALAQVDALRSDLGAVQNRFNSAITNLGNTVNNLSEARS

SEQ ID NO: 800 - protein, 541 aa, Artificial Sequence
  STF2.R3D0.HA1-2 PR8
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSR

SEQ ID NO: 801 - protein, 541 aa, Artificial Sequence
  STF2.R3D0.HA1-2 SI
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSR

SEQ ID NO: 802 - protein, 541 aa, Artificial Sequence
  STF2.R3D0.HA1-2 VN
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSESVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSR

SEQ ID NO: 803 - protein, 559 aa, Artificial Sequence
  STF2.R3D0.HA1-2 B/Mal
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKSKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSR

SEQ ID NO: 804 - protein, 764 aa, Artificial Sequence
  STF2.R03.HA1-2 PR8
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 805 - protein, 764 aa, Artificial Sequence
  STF2.R03.HA1-2 SI
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 806 - protein, 764 aa, Artificial Sequence
  STF2.R03.HA1-2 VN
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSESVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 807 - protein, 800 aa, Artificial Sequence
  STF2.R03.HA1-2 B/Mal
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 808 - protein, 583 aa, Artificial Sequence; identical to SEQ ID NO: 755
  STF2.D3N.HA1-2 SI

SEQ ID NO: 809 - protein, 583 aa, Artificial Sequence; identical to SEQ ID NO: 761
  STF2.D3N.HA1-2 VN

SEQ ID NO: 810 - protein, 573 aa, Artificial Sequence; identical to SEQ ID NO: 757
  STF2.D3NCs.HA1-2 SI

SEQ ID NO: 811 - protein, 573 aa, Artificial Sequence; identical to SEQ ID NO: 763
  STF2.D3NCs.HA1-2 VN

SEQ ID NO: 812 - protein, 453 aa, Artificial Sequence; identical to SEQ ID NO: 751
  STF2.D1.HA1-1 VN

SEQ ID NO: 813 - protein, 511 aa, Artificial Sequence
  Influenza A/Puerto Rico/8/34 HA0
DTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQ

SEQ ID NO: 814 - protein, 313 aa, Artificial Sequence
  STF2fliCR3D0
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGNADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSR

SEQ ID NO: 815 - protein, 354 aa, Artificial Sequence
  E. coliR3D0
MGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDSVTMGGTTYNFKTGADAGAATANAGVSFTDTASKETVLNKVATAKQGTAVAANGDTSATITYKSGVQTYQAVFAAGDGTASAKYADNTDVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSR

SEQ ID NO: 816 - protein, 228 aa, Artificial Sequence
  Bacillus subtillisR3D0
MGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGTTYTVSGWADADDATNKPAGYYDAGGKVIASEKLAADSKVTKGIDISSSAKAASSALTTIKTAIDTVSSERAKLGAVQNRLEHTINNLGTSSENLTSAESR

SEQ ID NO: 817 - protein, 355 aa, Artificial Sequence
  fliCD3N
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGNADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLR

SEQ ID NO: 818 - protein, 397 aa, Artificial Sequence
  E. coliD3N
MGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDSVTMGGTTYNFKTGADAGAATANAGVSFTDTASKETVLNKVATAKQGTAVAANGDTSATITYKSGVQTYQAVFAAGDGTASAKYADNTDVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQVPQQVLSLLQG

SEQ ID NO: 819 - protein, 260 aa, Artificial Sequence
  Bacillus subtillisD3N
MGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGTTYTVSGWADADDATNKPAGYYDAGGKVIASEKLAADSKVTKGIDISSSAKAASSALTTIKTAIDTVSSERAKLGAVQNRLEHTINNLGTSSENLTSAESRIRDVDMASEMMEYTKNNILTQASQAMLAQANQ

SEQ ID NO: 820 - protein, 345 aa, Artificial Sequence
  fliCD3NCs
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGNADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQ

SEQ ID NO: 821 - protein, 386 aa, Artificial Sequence
  E. coliD3NCs
MGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDSVTMGGTTYNFKTGADAGAATANAGVSFTDTASKETVLNKVATAKQGTAVAANGDTSATITYKSGVQTYQAVFAAGDGTASAKYADNTDVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQ

SEQ ID NO: 822 - protein, 260 aa, Artificial Sequence; identical to SEQ ID NO: 819
  Bacillus subtillisD3NCs

SEQ ID NO: 823 - protein, 181 aa, Artificial Sequence
  fliCD0D2D3
MGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQTTENPLQKIDAALAQVDTLRSDLGAVQNRFNSAITNLGNTVNNLTSARSR

SEQ ID NO: 824 - protein, 181 aa, Artificial Sequence
  E. coliD0D2D3
MGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNVTKDPLKALDEAISSIDKFRSSLGAIQNRLDSAVTNLNNTTTNLSEAQSR

SEQ ID NO: 825 - protein, 177 aa, Artificial Sequence
  Bacillus subtillisD0D2D3
MGLAISEKMRSQIRGLDMASKNAQDGISLIQTSEGALNETHSILQRMSELATQAANDTNTDSDRSELQKEMDQLASEVTRISTDTEFNTKKLLDGTAQNLTFQIGANEGQTMSLSINKMDSESLKVGAASSALTTIKTAIDTVSSERAKLGAVQNRLEHTINNLGTSSENLTSAESR

SEQ ID NO: 826 - protein, 565 aa, Artificial Sequence; identical to SEQ ID NO: 665
  HA full length SI

SEQ ID NO: 827 - protein, 565 aa, Artificial Sequence; identical to SEQ ID NO: 231
  HA full length sequence A/New Caledonia/20/99

SEQ ID NO: 828 - protein, 550 aa, Artificial Sequence
  HA full length sequence A/Wisconsin/67e5/2005
QKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 829 - protein, 565 aa, Artificial Sequence
  HA full length sequence A/Vietnam/1203/2004
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 830 - protein, 584 aa, Artificial Sequence
  HA full length sequence B/Florida/4/2006
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 831 - protein, 580 aa, Artificial Sequence
  HA full length sequence B/Malaysia/2506/2004
LSTHGSTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPKLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 832 - protein, 27 aa, Artificial Sequence
  GCN trimerization peptide
GYIPEAPRDGZAYVRKDGEWVLLSTFL

SEQ ID NO: 833 - protein, 4 aa, Artificial Sequence
  maturational cleavage site
  Xaa = naturally occurring amino acid
RXRR

SEQ ID NO: 834 - protein, 4 aa, Artificial Sequence
  maturational cleavage site
  Xaa = naturally occurring amino acid
RXKR

SEQ ID NO: 835 - protein, 30 aa, Artificial Sequence
  foldon
GYIPEAPRDGQAYVRKDGEWVLLSTFLSPA

SEQ ID NO: 836 - protein, 506 aa, Artificial Sequence; identical to SEQ ID NO: 12
  STF2

SEQ ID NO: 837 - protein, 7 aa, Artificial Sequence
  linker
GSGSGSG

SEQ ID NO: 838 - protein, 35 aa, Artificial Sequence
  GCNt peptide
EDKIEEILSKIYHIENEIARIKKLIGEAPGGIEGR

SEQ ID NO: 839 - protein, 5 aa, Artificial Sequence
  linker
GSGSG

SEQ ID NO: 840 - protein, 14 aa, Artificial Sequence
  RSV G peptide
QRQNKPPSKPNNDF

SEQ ID NO: 841 - protein, 8 aa, Artificial Sequence
  RSV G peptide
FEVFNFVP

SEQ ID NO: 842 - protein, 17 aa, Artificial Sequence
  RSV G peptide
VPCSICSNNPTCWAICK

SEQ ID NO: 843 - protein, 9 aa, Artificial Sequence
  RSV G peptide
KKTTTKPTK

SEQ ID NO: 844 - protein, 5 aa, Artificial Sequence
  chemokine motif
  Xaa = any amino acid
CXXXC

SEQ ID NO: 845 - protein, 753 aa, Artificial Sequence
  RSVF(234-480).STF2
TREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 846 - DNA, 2259 bp, Artificial Sequence
  RSVF(234-480).STF2
accagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacgttaacaagcaggagggtaagagtttgtacgtaaagggtgagcccatcatcaacttctatgatcctatggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactacga

SEQ ID NO: 847 - protein, 773 aa, Artificial Sequence
  RSVF(26-60,234-458).STF2
QNITEEFYQSTCSAVSKGYLSALRTGWYTSVITIEGSGSGSGTREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 848 - DNA, 2319 bp, Artificial Sequence
  RSVF(26-60,234-458).STF2
caaaacattacggaggaattctaccagtccacctgctctgcagtctcaaagggttatttgtccgctctcaggaccggatggtacacctccgtcatcaccatcgagggttctggttctggttctggtaccagagagttctcagtgaatgccggtgtcaccaccccagtttctacctatatgctcacaaactcggaattgctttcactgattaacgacatgccaatcacgaacgaccaaaagaagctgatgtccaacaacgttcaaatcgttcgtcaacagtcctactcaatcatgtccattatcaaggaggaagtgctggcctacgtagttcaactgcccctgtatggagtgattgacactccctgttggaaactccacaccagccccctttgtacgaccaacaccaaagagggatctaacatctgtttgacgcgcaccgaccgtggttggttctgcgacaacgctggaagcgttagtttcttccctcaggccgaaacatgcaaggtccaatcgaatcgcgtgttctgcgataccatgaactcattgacgttgccaagcgaagtcaatttgtgcaacgtggatatcttcaatccaaaatacgactgtaagatcatgacgagtaaaacggacgtttccagttctgtgattacctccctgggtgccatcgtgtcgtgctacggtaaaaccaagtgcactgcctcaaacaaaaatcgcggcatcatcaagactttctctaacggttgcgattatgtgtctaacaaaggcgttgacaccgtctctgtcggaaacactctgtactacatggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactacga

SEQ ID NO: 849 - protein, 9 aa, Artificial Sequence
  RSVG T cell epitope
FHFEVFNFV

SEQ ID NO: 850 - protein, 574 aa, Artificial Sequence
  Human respiratory syncytial virus A2
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

What is claimed is:

1. A fusion protein comprising at least one protein with the amino acid sequence as set forth in SEQ ID NO: 29 and at least a portion of at least one viral antigen, wherein the viral antigen is between amino acid residues 190 and 191 of SEQ ID NO: 29, and wherein the fusion protein activates a Toll-like Receptor 5.

2. A fusion protein comprising at least one protein with the amino acid sequence as set forth in SEQ ID NO: 29 and at least a portion of at least a first antigen and at least a portion of at least a second antigen, wherein the first antigen is between amino acid residues 190 and 191 of SEQ ID NO: 29, the second antigen is fused to amino acid residue 405 of SEQ ID NO: 29, and the fusion protein activates a Toll-like Receptor 5.

3. A protein that includes, in sequence, an amino-domain 0 of a flagellin protein, an amino-domain 1 of the flagellin protein, an amino-domain 2 of the flagellin protein, at least a portion of at least one viral antigen, a carboxy-domain 2 of the flagellin protein, a carboxy-domain 1 of the flagellin protein and a carboxy-domain 0 of the flagellin protein, wherein the protein activates Toll-like Receptor 5.

4. The protein of claim 3, further including at least a portion of at least one additional antigen fused to the carboxy-domain 0 of the flagellin protein.

5. The protein of claim 4, wherein the additional antigen includes a portion of an influenza viral hemagglutinin protein that includes at least a portion of a globular head.

6. The protein of claim 5, wherein the at least one viral antigen between the amino-domain 2 and the carboxy-domain 2 includes a portion of an influenza viral hemagglutinin that includes at least a portion of a globular head.

7. The fusion protein of claim 1, wherein the at least one viral antigen includes a portion of an influenza viral hemagglutinin protein that includes at least a portion of a globular head.

8. The fusion protein of claim 2, wherein the first antigen includes a portion of an influenza viral hemagglutinin protein that includes at least a portion of a globular head.

9. The fusion protein of claim 8, wherein the second antigen is at least a portion of at least one matrix 2 protein.

10. The fusion protein of claim 9, wherein the portion of matrix 2 protein includes a portion of at least one ectodomain of the matrix 2 protein.

11. The fusion protein of claim 10, wherein the portion of the matrix 2 protein includes four portions of the ectodomain of the matrix 2 protein.

12. The protein of claim 4, wherein the one additional antigen is distinct from the viral antigen between the amino-domain 2 and the carboxy-domain 2 of the flagellin protein.

13. The protein of claim 4, wherein the one additional antigen is similar to the viral antigen between the amino-domain 2 and the carboxy-domain 2 of the flagellin protein.

14. The fusion protein of claim 1, further including an amino acid linker between the viral antigen and at least one of amino acid residues 190 and 191 of SEQ ID NO: 29.

15. The fusion protein of claim 2, further including an amino acid linker between the first antigen and at least one of amino acid residues 190 and 191 of SEQ ID NO: 29.

16. The fusion protein of claim 15, further including an amino acid linker between the second antigen and amino acid residue 405 of SEQ ID NO: 29.

17. The fusion protein of claim 2, further including an amino acid linker between the second antigen and amino acid residue 405 of SEQ ID NO: 29.

18. The fusion protein of claim 2, wherein the first antigen is distinct from the second antigen.

19. The fusion protein of claim 2, wherein the first antigen is similar to the second antigen.

20. The protein of claim 6, wherein the portion of the influenza viral hemagglutinin of at least one of the one antigen or the additional antigen is from at least one member selected from the group consisting of a H1, H2, H3, H4, H5, H7, H9 and H13 strain of influenza.

21. The fusion protein of claim 8, wherein the second antigen includes a portion of an influenza viral hemagglutinin protein that includes at least a portion of a globular head.

22. The fusion protein of claim 21, wherein the influenza viral hemagglutinin of at least one of the first antigen or the second antigen is from at least one member selected from the group consisting of a H1, H2, H3, H4, H5, H7, H9 and H13 strain of influenza.

23. The protein of claim 3, wherein the flagellin protein is at least one member selected from the group consisting of *Salmonella typhimurium* flagellin, an *E coli* flagellin, a *S. muenchen* flagellin, a *Yersinia* flagellin, a *P. aeruginosa* flagellin and a *L. monocytogenes* flagellin.

24. The protein of claim 5, wherein the portion of the influenza viral hemagglutinin is from at least one member selected from the group consisting of a H1, H2, H3, H4, H5, H7, H9 and H13 strain of influenza.

25. The protein of claim 5, wherein the portion of the influenza viral hemagglutinin is at least one member selected from the group consisting of a portion of an influenza A viral hemagglutinin and a portion of an influenza B viral hemagglutinin.

26. The protein of claim 5, wherein the portion of the influenza viral hemagglutinin is a portion of an influenza C viral hemagglutinin.

27. The fusion protein of claim 7, wherein the influenza viral hemagglutinin is from at least one member selected from the group consisting of a H1, H2, H3, H4, H5, H7, H9 and H13 strain of influenza.

28. The fusion protein of claim 7, wherein the influenza viral hemagglutinin is at least one member selected from the group consisting of an influenza A viral hemagglutinin and an influenza B viral hemagglutinin.

29. The fusion protein of claim 7, wherein the influenza viral hemagglutinin is an influenza C viral hemagglutinin.

30. The protein of claim 3, wherein the flagellin protein has at least about 85% identity to the contiguous amino acid sequence as set forth in SEQ ID NO: 29.

31. The protein of claim 3, wherein the flagellin protein has at least about 90% identity to the contiguous amino acid sequence as set forth in SEQ ID NO: 29.

32. The protein of claim 3, wherein the flagellin protein has at least about 95% identity to the contiguous amino acid sequence as set forth in SEQ ID NO: 29.

33. The protein of claim 3, wherein the flagellin protein has at least 98% identity to the contiguous amino acid sequence as set forth in SEQ ID NO: 29.

34. The protein of claim 3, wherein the flagellin protein has at least 99% identity to the contiguous amino acid sequence as set forth in SEQ ID NO: 29.

35. The fusion protein of claim 1, wherein the fusion protein is associated with at least one nanoparticle.

36. The fusion protein of claim 2, wherein the fusion protein is associated with at least one nanoparticle.

37. The protein of claim 3, further including at least one nanoparticle that is associated with the protein.

38. The protein of claim 4, further including at least one nanoparticle that is associated with the protein.

39. The fusion protein of claim 8, wherein the influenza viral hemagglutinin is at least one member selected from the group consisting of an influenza A viral hemagglutinin and an influenza B viral hemagglutinin.

40. The fusion protein of claim 1, wherein the viral antigen includes an influenza viral antigen.

41. The fusion protein of claim 40, wherein the influenza viral antigen includes at least a portion influenza viral hemagglutinin protein.

42. The fusion protein of claim 40, wherein the influenza viral antigen includes at least one ectodomain peptide of a matrix 2 protein.

43. The protein of claim 3, wherein the viral antigen includes an influenza viral antigen.

44. The protein of claim 43, wherein the influenza viral antigen includes at least a portion of an influenza viral hemagglutinin protein.

45. The protein of claim 44, wherein the influenza viral antigen includes at least one ectodomain peptide of a matrix 2 protein.

* * * * *